United States Patent
Zhang et al.

(10) Patent No.: US 11,840,711 B2
(45) Date of Patent: Dec. 12, 2023

(54) TYPE VI CRISPR ORTHOLOGS AND SYSTEMS

(71) Applicants: THE BROAD INSTITUTE, INC., Cambridge, MA (US); MASSACHUSETTS INSTITUTE OF TECHNOLOGY, Cambridge, MA (US)

(72) Inventors: Feng Zhang, Cambridge, MA (US); David Benjamin Turitz Cox, Cambridge, MA (US)

(73) Assignees: THE BROAD INSTITUTE, INC., Cambridge, MA (US); MASSACHUSETTS INSTITUTE OF TECHNOLOGY, Cambridge, MA (US)

( * ) Notice: Subject to any disclaimer, the term of this patent is extended or adjusted under 35 U.S.C. 154(b) by 692 days.

(21) Appl. No.: 16/604,724

(22) PCT Filed: Apr. 11, 2018

(86) PCT No.: PCT/US2018/027125
§ 371 (c)(1),
(2) Date: Oct. 11, 2019

(87) PCT Pub. No.: WO2018/191388
PCT Pub. Date: Oct. 18, 2018

(65) Prior Publication Data
US 2021/0071158 A1    Mar. 11, 2021

Related U.S. Application Data

(60) Provisional application No. 62/484,791, filed on Apr. 12, 2017, provisional application No. 62/561,662, filed on Sep. 21, 2017, provisional application No. 62/568,129, filed on Oct. 4, 2017.

(51) Int. Cl.
| | |
|---|---|
| *C12N 9/22* | (2006.01) |
| *C12N 15/11* | (2006.01) |
| *C12Q 1/6823* | (2018.01) |
| *C12N 15/10* | (2006.01) |
| *C12N 15/63* | (2006.01) |
| *C12N 15/113* | (2010.01) |
| *C12N 15/86* | (2006.01) |
| *C12Q 1/6897* | (2018.01) |

(52) U.S. Cl.
CPC .............. *C12N 9/22* (2013.01); *C12N 15/11* (2013.01); *C12Q 1/6823* (2013.01); *C12N 2310/20* (2017.05)

(58) Field of Classification Search
None
See application file for complete search history.

(56) References Cited

U.S. PATENT DOCUMENTS

| | | |
|---|---|---|
| 5,543,158 A | 8/1996 | Gref et al. |
| 5,855,913 A | 1/1999 | Hanes et al. |
| 5,985,309 A | 11/1999 | Edwards et al. |
| 6,007,845 A | 12/1999 | Domb et al. |
| 6,603,061 B1 | 8/2003 | Armstrong et al. |
| 6,750,059 B1 | 6/2004 | Blakesley et al. |
| 7,259,015 B2 | 8/2007 | Kingsman et al. |
| 7,303,910 B2 | 12/2007 | Bebbington et al. |
| 7,351,585 B2 | 4/2008 | Mitrophanous et al. |
| 7,745,651 B2 | 6/2010 | Heyes et al. |
| 7,776,321 B2 | 8/2010 | Cascalho et al. |
| 7,799,565 B2 | 9/2010 | Maclachlan et al. |
| 7,803,397 B2 | 9/2010 | Heyes et al. |
| 7,838,658 B2 | 11/2010 | Maclachlan et al. |
| 7,868,149 B2 | 1/2011 | Boukharov et al. |
| 7,901,708 B2 | 3/2011 | Maclachlan et al. |
| 7,915,399 B2 | 3/2011 | Maclachlan et al. |
| 7,982,027 B2 | 7/2011 | Maclachlan et al. |
| 8,044,019 B2 | 10/2011 | Uno et al. |
| 8,058,069 B2 | 11/2011 | Yaworski et al. |
| 8,101,741 B2 | 1/2012 | Maclachlan et al. |
| 8,188,263 B2 | 5/2012 | Maclachlan et al. |
| 8,236,943 B2 | 8/2012 | Lee et al. |
| 8,283,333 B2 | 10/2012 | Yaworski et al. |
| 8,372,951 B2 | 2/2013 | Chang et al. |
| 8,575,305 B2 | 11/2013 | Gait et al. |
| 8,614,194 B1 | 12/2013 | Chen et al. |

(Continued)

FOREIGN PATENT DOCUMENTS

| | | |
|---|---|---|
| CA | 3028158 A1 | 12/2017 |
| CA | 3059757 A1 | 10/2018 |

(Continued)

OTHER PUBLICATIONS

International Preliminary Report on Patentability issued in International Application No. PCT/US2018/027125, dated Oct. 24, 2019, 11 pages.
Abil et al., "Engineering Reprogrammable RNA-Binding Proteins for Study and Manipulation of the Transcriptome", Molecular BioSystems, The Royal Society of Chemistry, vol. 11, No. 10, Jul. 6, 2015, 8 pages.
Abudayyeh et al., "RNA Targeting with CRISPR-Cas13a", Nature, vol. 550, No. 7675, Oct. 4, 2017, 30 pages.

(Continued)

*Primary Examiner* — Manjunath N Rao
*Assistant Examiner* — Jae W Lee
(74) *Attorney, Agent, or Firm* — F. Brent Nix, Esq.; Johnson, Marcou, Isaacs & Nix, LLC

(57) ABSTRACT

The invention provides for systems, methods, and compositions for targeting nucleic acids. In particular, the invention provides non-naturally occurring or engineered RNA-targeting systems comprising a novel RNA-targeting CRISPR effector protein and at least one targeting nucleic acid component like a guide RNA.

20 Claims, 30 Drawing Sheets

Specification includes a Sequence Listing.

(56) References Cited

U.S. PATENT DOCUMENTS

| | | | |
|---|---|---|---|
| 8,709,843 | B2 | 4/2014 | Shakuda |
| 8,889,418 | B2 | 11/2014 | Zhang et al. |
| 8,895,308 | B1 | 11/2014 | Zhang et al. |
| 2003/0087817 | A1 | 5/2003 | Cox et al. |
| 2004/0013648 | A1 | 1/2004 | Kingsman et al. |
| 2004/0142476 | A1 | 7/2004 | Evans et al. |
| 2004/0171156 | A1 | 9/2004 | Hartley et al. |
| 2005/0019923 | A1 | 1/2005 | Uchegbu et al. |
| 2006/0281180 | A1 | 12/2006 | Radcliffe et al. |
| 2007/0025970 | A1 | 2/2007 | Kingsman et al. |
| 2007/0054961 | A1 | 3/2007 | Maden et al. |
| 2008/0267903 | A1 | 10/2008 | Uchegbu et al. |
| 2009/0007284 | A1 | 1/2009 | Radcliffe et al. |
| 2009/0017543 | A1 | 1/2009 | Wilkes et al. |
| 2009/0100536 | A1 | 4/2009 | Adams et al. |
| 2009/0111106 | A1 | 4/2009 | Mitrophanous et al. |
| 2010/0317109 | A1 | 12/2010 | Maden et al. |
| 2011/0117189 | A1 | 5/2011 | Mazzone et al. |
| 2011/0195123 | A1 | 8/2011 | Shemi |
| 2011/0265198 | A1 | 10/2011 | Gregory et al. |
| 2011/0293571 | A1 | 12/2011 | Widdowson et al. |
| 2011/0293703 | A1 | 12/2011 | Mahon et al. |
| 2012/0003201 | A1 | 1/2012 | Nicholas et al. |
| 2012/0017290 | A1 | 1/2012 | Cui et al. |
| 2012/0251560 | A1 | 10/2012 | Dahlman et al. |
| 2012/0251618 | A1 | 10/2012 | Schrum et al. |
| 2012/0295960 | A1 | 11/2012 | Palfi et al. |
| 2013/0236946 | A1 | 9/2013 | Gouble |
| 2013/0244279 | A1 | 9/2013 | De Fougerolles et al. |
| 2013/0245107 | A1 | 9/2013 | De Fougerolles et al. |
| 2013/0252281 | A1 | 9/2013 | De Fougerolles et al. |
| 2014/0186919 | A1 | 7/2014 | Zhang et al. |
| 2014/0242700 | A1 | 8/2014 | Zhang et al. |
| 2014/0273234 | A1 | 9/2014 | Zhang et al. |
| 2014/0335620 | A1 | 11/2014 | Zhang et al. |
| 2014/0357530 | A1 | 12/2014 | Zhang et al. |
| 2017/0166903 | A1 | 6/2017 | Zhang et al. |
| 2019/0359971 | A1 | 11/2019 | Zhang et al. |
| 2020/0131488 | A1* | 4/2020 | Cox ................. C12N 15/86 |

FOREIGN PATENT DOCUMENTS

| | | |
|---|---|---|
| CN | 105899657 A | 8/2016 |
| CN | 106029880 A | 10/2016 |
| EP | 1 519 714 A1 | 4/2005 |
| EP | 1 766 035 B1 | 12/2011 |
| EP | 1 781 593 B1 | 12/2011 |
| EP | 1 664 316 B1 | 8/2012 |
| WO | 2011/143124 A2 | 11/2011 |
| WO | 2012/135025 A2 | 10/2012 |
| WO | 2014/018423 A2 | 1/2014 |
| WO | 2014/093622 A2 | 6/2014 |
| WO | 2014/093635 A1 | 6/2014 |
| WO | 2014/093701 A1 | 6/2014 |
| WO | 2015/089419 A2 | 6/2015 |
| WO | 2015/184016 A2 | 12/2015 |
| WO | 2017/070605 A1 | 4/2017 |
| WO | 2017070605 A1 | 4/2017 |
| WO | 2018/191388 A1 | 10/2018 |

OTHER PUBLICATIONS

Allerson et al., "Fully 2'-Modified Oligonucleotide Duplexes with Improved in Vitro Potency and Stability Compared to Unmodified Small Interfering RNA", Journal of Medicinal Chemistry, vol. 48, No. 4, Jan. 20, 2005, 901-904.

Ballatore et al., "Tau-Mediated Neurodegeneration in Alzheimer's Disease and Related Disorders", Nature Reviews Neuroscience, vol. 8, No. 9, Sep. 2007, 663-672.

Banaszynski et al., "A Rapid, Reversible, and Tunable Method to Regulate Protein Function in Living Cells Using Synthetic Small Molecules", Cell, vol. 126, No. 5, Sep. 8, 2006, 995-1004.

Banaszynski et al., "Chemical Control of Protein Stability and Function in Living Mice", Nature Medicine, vol. 14, No. 10, Oct. 2008, 13 pages.

Bass et al., "An Unwinding Activity that Covalently Modifies its Double-Stranded RNA Substrate", Cell, vol. 55, No. 6, Dec. 23, 1988, 1089-1098.

Belhaj et al., "Plant Genome Editing Made Easy: Targeted Mutagenesis in Model and Crop Plants Using the CRISPR/Cas System", Plant Methods, vol. 9, No. 1, Oct. 11, 2013, 1-10.

Bramsen et al., "Development of Therapeutic-Grade Small Interfering RNAs by Chemical Engineering", Frontiers in Genetics, vol. 3, Article 154, Aug. 2012, 22 pages.

Brooks et al., "Efficient Gene Editing in Tomato in the First Generation Using the Clustered Regularly Interspaced Short Palindromic Repeats/CRISPR-Associated9 System", Plant Physiology, vol. 166, No. 3, Nov. 2014, 1292-1297.

Daliando et al., "Targeted DNA Degradation using a CRISPR Device Stably Carried in the Host Genome", Nature Communications, vol. 6, No. 6989, May 19, 2015, 10 pages.

Canver et al., "BCL11A Enhancer Dissection by Cas9-Mediated In Situ Saturating Mutagenesis", Nature, vol. 527, No. 7577, Nov. 12, 2015, 23 pages.

Chen et al., "Genome-Wide CRISPR Screen in a Mouse Model of Tumor Growth and Metastasis", Cell, vol. 160, No. 6, Mar. 12, 2015, 28 pages.

Chen et al., "Predicting Peptide-Mediated Interactions on a Genome-Wide Scale", PLOS Computational Biology, vol. 11, No. 5, May 4, 2015, 13 pages.

Chen et al., "RNA Imaging Spatially Resolved, Highly Multiplexed RNA Profiling in Single Cells", Science, vol. 348, No. 6233, Apr. 24, 2015, 14 pages.

Cong et al., "Multiplex Genome Engineering Using CRISPR/Cas Systems", Science, vol. 339, No. 6121, Feb. 15, 2013, 6 pages.

Curtin et al., "A Genome Engineering Toolbox for Legume Functional Genomics", Plant and Animal Genome XXII, Poster P209, Jan. 13, 2014, 2 pages.

Dahlman et al., "In Vivo Endothelial Sima Delivery Using Polymeric Nanoparticles with Low Molecular Weight", Nature Nanotechnology, vol. 9, No. 8, Aug. 2014, 17 pages.

Dahlman et al., "Orthogonal Gene Knock Out and Activation with a Catalytically Active Cas9 Nuclease", Nature Biotechnology, vol. 33, No. 11, Nov. 2015, 11 pages.

Deng et al., "CASFISH: CRISPR/Cas9-mediated in Situ Labeling of Genomic Loci in Fixed Cells", Proceedings of the National Academy of Sciences, vol. 112, No. 38, Sep. 22, 2015, 11870-11875.

Dey et al., "Toward a "Structural BLAST": Using Structural Relationships to Infer Function", Protein Science, vol. 22, No. 4, Apr. 2013, 359-366.

Doench et al., "Rational Design of Highly Active SgRNAs for CRISPR-Cas9-Mediated Gene Inactivation", Nature Biotechnology, vol. 32, No. 12, Dec. 2014, 17 pages.

Feng et al., "Efficient Genome Editing in Plants using a CRISPR/Cas System", Cell Research, vol. 23, Issue 10, Oct. 2013, 1229-1232.

Finkel et al., "Treatment of Infantile-Onset Spinal Muscular Atrophy with Nusinersen: A Phase 2, Open-Label, Dose-Escalation Study", The Lancet, vol. 388, Issue 10063, Dec. 2016, 3017-3026.

Fukuda et al., "Construction of a Guide-RNA for Site-Directed RNA Mutagenesis Utilising Intracellular A-To-I RNA Editing", Scientific Reports, vol. 7, No. 41478, Feb. 2017, 13 pages.

Gambino et al., "Simultaneous Detection of Nine Grapevine Viruses by Multiplex Reverse Transcription-Polymerase Chain Reaction with Coamplification of a Plant RNA as Internal Control", Phytopathology, vol. 96, No. 11, Nov. 2006, 1223-1229.

Gao et al., "A De Novo Loss-Of-Function GRIN2A Mutation Associated with Childhood Focal Epilepsy and Acquired Epileptic Aphasia", PLOS One, vol. 12, No. 12, Feb. 9, 2017, 20 pages.

Gao et al., "Engineered Cpf1 Enzymes with Altered PAM Specificities", Nature Biotechnology, vol. 35, No. 8, Dec. 4, 2016, 17 pages.

(56) References Cited

OTHER PUBLICATIONS

"A Portal of CRISPR-Cas9 Mediated Genome Editing", University of Arizona website "CRISPR-PLANT" supported by Penn State and AGI, Retrieved as on Jun. 26, 2020, "http://www.genome.arizona.edu/crispr/", 2 pages.
Gootenberg et al., "Nucleic Acid Detection with CRISPR-Cas13a/C2c2", Science, vol. 356, No. 6336, Apr. 28, 2017, 6 pages.
Hale et al., "RNA-Guided RNA Cleavage by a CRISPR RNA-Cas Protein Complex", Cell, vol. 139, No. 5, Nov. 25, 2009, 945-956.
Hale et al., "Target RNA Capture and Cleavage by The Cmr Type III-B CRISPR-Cas Effector Complex", Genes and Development, vol. 28, No. 21, 2014. 2432-2443.
Hebelstrup et al., "The Future of Starch Bioengineering: GM Microorganisms or GM Plants?", Frontiers in Plant Science, vol. 6, Article 247, Apr. 23, 2015, 6 pages.
Hendel et al., "Chemically Modified Guide RNAs Enhance CRISPR-Cas Genome Editing in Human Primary Cells", Nature Biotechnology, vol. 33, No. 9, Sep. 2015, 985-989.
Hsu et al., "Development and Applications of CRISPR-Cas9 for Genome Engineering", Cell, vol. 157, No. 6, Jun. 5, 2014, 34 pages.
Hsu et al., "DNA Targeting Specificity of RNA-Guided Cas9 Nucleases", Nature Biotechnology, vol. 31, No. 9, Sep. 2013, 827-832.
Jiang et al., "RNA-Guided Editing of Bacterial Genomes Using CRISPR-Cas Systems", Nature Biotechnology, vol. 31, No. 3, Mar. 2013, 233-239.
Kabadi et al., "Multiplex CRISPR/Cas9-based Genome Engineering from a Single Lenttiviral Vector", Nucleic Acids Research, vol. 42, No. 19, Aug. 13, 2014, 11 pages.
Kim et al., "A Guide to Genome Engineering with Programmable Nucleases", Nature Reviews Genetics, vol. 15, May 2014, 321-334.
Kim et al., "Increasing the Genome-Targeting Scope and Precision of Base Editing with Engineered Cas9-Cytidine Deaminase Fusions", Nature Biotechnology, vol. 35, No. 4, Feb. 13, 2017, 371-376.
Komor et al., "CRISPR-Based Technologies for the Manipulation of Eukaryotic Genomes", Cell, vol. 168, No. (1-2), Jan. 12, 2017, 34 pages.
Komor et al., "Programmable Editing of a Target Base in Genomic DNA without Double-Stranded DNA Cleavage", Nature, vol. 533, No. 7603, May 19, 2016, 25 pages.
Konermann et al., "Genome-Scale Transcriptional Activation by an Engineered CRISPR-Cas9 Complex", Nature, vol. 517, No. 7536, Jan. 29, 2015, 18 pages.
Konermann et al., "Optical Control of Mammalian Endogenous Transcription and Epigenetic States", Nature, vol. 500, No. 7463, Aug. 22, 2013, 18 pages.
Kurth et al., "Virus-Derived Gene Expression and RNA Interference Vector for Grapevine", Journal of Virology, vol. 86, No. 11, Jun. 2012, 6002-6009.
Kuttan et al., "Mechanistic Insights into Editing-Site Specificity of ADARs", Proceedings of the National Academy of Sciences of the United States of America, vol. 109, No. 48, Nov. 27, 2012, E3295-E3304.
Lanoiselee et al., "APP, PSEN1, And PSEN2 Mutations in Early-Onset Alzheimer Disease: A Genetic Screening Study of Familial and Sporadic Cases", PLOS Medicine, vol. 14, No. 3, Mar. 28, 2017, 16 pages.
Lehmann et al., "Double-Stranded RNA Adenosine Deaminases ADAR1 and ADAR2 Have Overlapping Specificities", Biochemistry, vol. 39, No. 42, 2000, 12875-12884.
Li et al., "Carriers of Rare Missense Variants in IFIH1 are Protected from Psoriasis", Journal of Investigative Dermatology, vol. 130, No. 12, Dec. 2010, 9 pages.
Zhou et al., "Exploiting SNPs for Biallelic CRISPR Mutations in the Outcrossing Woody Perennial Populus Reveals 4-coumarate:CoA ligase Specificity and Redundancy", New Phytologist, vol. 208, Oct. 2015, 298-301.
Xu et al., "Sequence Determinants of Improved CRISPR SgRNA Design", Genome Research, vol. 25, No. 8, Aug. 2015, 11 pages.

Yin et al., "A Geminivirus-Based Guide RNA Delivery System for CRISPR/Cas9 Mediated Plant Genome Editing", Scientific Reports, vol. 5, Article No. 14926, Oct. 9, 2015, 10 pages.
Zetsche et al., "A Split-Cas9 Architecture for Inducible Genome Editing and Transcription Modulation", Nature Biotechnology, vol. 33, No. 2, Feb. 2015, 139-142.
Zetsche et al., "Cpf1 is a Single RNA-Guided Endonuclease of a Class 2 CRISPR-Cas System", Cell, vol. 163, No. 3, Oct. 22, 2015, 759-771.
Zhang et al., "Structure-Based Prediction of Protein-Protein Interactions on a Genome-Wide Scale", Nature, vol. 490, Oct. 25, 2012, 556-560.
Price, Aryn A., et al., "Cas9-Mediated Targeting of Viral RNA in Eukaryotic Cells," May 12, 2015, Proceedings of the National Academy of Sciences, vol. 112, No. 19, pp. 6164-6169.
Nelles, David A., et al., "Programmable RNA Tracking in Live Cells wit CRISPR/Cas 9," Mar. 17, 2016, Cell, Cell Press, vol. 165, No. 2, pp. 488-496.
Abuydayyeh, O.O., et al., "C2c2 is a Single-Component Programmable RNA-Guided RNA-Targeting CRISPR Effector," Jun. 2, 2016, Science, vol. 353, No. 6299, all enclosed pages cited.
Liu, Yuchen, et al., "Targeting Cellular mRNA's Translation by CRISPR-Cas9," Jul. 13, 2016, Scientific Reports, vol. 6, No. 1, all enclosed pages cited.
East-Seletsky, et al., "Two Distinct RNase Activities of CRISPR-C2c2 Enable Guide-RNA Processing and RNA Detection," Oct. 13, 2016, Nature, vol. 538, No. 7624, pp. 270-273.
Smargon, Aaron, et al., "Cas13b is a Type VI-B CRISPR-Associated RNA-Guided RNase Differentially Regulated by Accessory Proteins Csx27 and Csx28," Jan. 5, 2017, Molecular Cell, vol. 65, No. 4, all enclosed pages cited.
Barrangou, Rodolphe, et al., "Expanding the CRISPR Toolbox: Targeting RNA with Cas13b," Feb. 16, 2017, Molecular Cell, vol. 65, No. 4, pp. 582-584.
Cox, David B.T., et al., "RNA Editing with CRISPR-Cas13," Nov. 24, 2017, Science, vol. 358, No. 6366, pp. 1019-1027.
International Search Report and Written Opinion of PCT/US2018/027125 dated Jul. 26, 2018, all enclosed pages cited.
Office Action from corresponding Saudi Arabian application No. 519410294 dated Feb. 10, 2022, all enclosed pages cited.
Office Action from corresponding Japanese application No. 2019-555810 dated Mar. 15, 2022, all enclosed pages cited.
Xu et al., "Gene Targeting using the Agrobacterium Tumefaciens-Mediated CRISPR-Cas System in Rice", Rice, vol. 7, No. 1, May 2, 2014, 4 pages.
Li et al., "Engineering CRISPR-Cpf1 CrRNAS and MRNAs to Maximize Genome Editing Efficiency", Nature Biomedical Engineering, vol. 1, No. 5, May 2017, 21 pages.
Lowder et al., "A CRISPR/Cas9 Toolbox for Multiplexed Plant Genome Editing and Transcriptional Regulation", Plant Physiology, vol. 169, No. 2, Oct. 2015, 15 pages.
Ma et al., "A Robust CRISPR/Cas9 System for Convenient, High-Efficiency Multiplex Genome Editing in Monocot and Dicot Plants", Molecular Plant, vol. 8, No. 8, Aug. 3, 2015, 1274-1284.
Mackay et al., "The Prospects for Designer Single-Stranded RNA-Binding Proteins", Nature Structural & Molecular Biology, vol. 18, No. 3, Mar. 2011, 256-261.
Mali et al., "RNA-Guided Human Genome Engineering via Cas9", Science, vol. 339, No. 6121, Feb. 15, 2013, 8 pages.
Matthews et al., "Structures of Human ADAR2 Bound to dsRNA Reveal Base-flipping Mechanism and Basis for Site Selectivity", Nature Structural & Molecular Biology, vol. 23, No. 5, May 2016, 23 pages.
Maynard-Smith et al., "A Directed Approach for Engineering Conditional Protein Stability Using Biologically Silent Small Molecules", The Journal Of Biological Chemistry, vol. 282, No. 34, Aug. 24, 2007, 24866-24872.
Miyazaki et al., "Destabilizing Domains Derived from the Human Estrogen Receptor", Journal of the American Chemical Society, vol. 134, No. 9, Mar. 7, 2012, 3942-3945.
Montiel-Gonzalez et al., "An Efficient System for Selectively Altering Genetic Information within mRNAs", Nucleic Acids Research, vol. 44, No. 21, Aug. 23, 2016, 12 pages.

(56) References Cited

OTHER PUBLICATIONS

Montiel-Gonzalez et al., "Correction of Mutations within the Cystic Fibrosis Transmembrane Conductance Regulator by Site-Directed RNA Editing", Proceedings of the National Academy of Sciences, vol. 110, No. 45, Nov. 5, 2013, 11 pages.
Morrell et al., "Crop Genomics: Advances and Applications", Nature Reviews Genetics, vol. 13, No. 2, Feb. 2012, 85-96.
Murray et al., "Suppressors of RNAi from Plant Viruses are Subject to Episodic Positive Selection", Proceedings of The Royal Society B, vol. 280, No. 1765, Jun. 2013, 10 pages.
Nelles et al., "Applications of Cas9 as an RNA-Programmed RNA-Binding Protein", Bioessays, vol. 37, Jul. 2015, 1-8.
Nishida et al., "Targeted Nucleotide Editing Using Hybrid Prokaryotic and Vertebrate Adaptive Immune Systems", Science, vol. 353, No. 6305, Sep. 16, 2016, 10 pages.
Nishikura, Kazuko, "Functions and Regulation of RNA Editing by ADAR Deaminases", Annual Review of Biochemistry, vol. 79, 2010, 33 pages.
Nishimasu et al., "Crystal Structure of Cas9 in Complex with Guide RNA and Target DNA", Cell, vol. 156, No. 5, Feb. 27, 2014, 25 pages.
Nishimasu et al., "Crystal Structure of *Staphylococcus aureus* Cas9", Cell, vol. 162, No. 5, Aug. 27, 2015, 33 pages.
Parnas et al., "A Genome-Wide CRISPR Screen in Primary Immune Cells to Dissect Regulatory Networks", Cell, vol. 162, No. 3, Jul. 30, 2015, 24 pages.
Peng et al., "An Archaeal CRISPR Type III-B System Exhibiting Distinctive RNA Targeting Features and Mediating Dual RNA and DNA Interference", Nucleic Acids Research, vol. 43, No. 1, Jan. 2015, 406-417.
Petersen et al., "Towards Precisely Glyco Engineered Plants", Plant Biotech Denmark Annual Meeting, Jan. 28-29, 2015, 6 pages.
Platt et al., "CRISPR-Cas9 Knockin Mice for Genome Editing and Cancer Modeling", Cell, vol. 159, No. 2, Oct. 9, 2014, 31 pages.
Ramakrishna et al., "Gene Disruption by Cell-Penetrating Peptide-Mediated Delivery of Cas9 Protein and Guide RNA", Genome Research, vol. 24, No. 6, Jun. 2014, 1020-1027.
Ramanan et al., "CRISPR/Cas9 Cleavage of Viral DNA Efficiently Suppresses Hepatitis B Virus", Scientific Reports, vol. 5, No. 10833, Jun. 2, 2015, 9 pages.
Ran et al., "Double Nicking by RNA-Guided CRISPR Cas9 for Enhanced Genome Editing Specificity", Cell, vol. 154, No. 6, Sep. 12, 2013, 19 pages.
Ran et al., "Genome Engineering Using the CRISPR-Cas9 System", Nature Protocols, vol. 8, No. 11, Nov. 2013, 49 pages.
Ran et al., "In Vivo Genome Editing using *Staphylococcus aureus* Cas9", Nature, vol. 520, No. 7546, Apr. 1, 2015, 30 pages.
Rodriguez et al., "Targeted Chemical-Genetic Regulation of Protein Stability In Vivo", Chemistry & Biology, vol. 19, No. 3, Mar. 23, 2012, 391-398.
Schneider et al., "Optimal Guidernas for Re-Directing Deaminase Activity of hADAR1 and hADAR2 in Trans", Nucleic Acids Research, vol. 42, Issue 10, Apr. 17, 2014, 9 pages.
Shalem et al., "Genome-Scale CRISPR-Cas9 Knockout Screening in Human Cells", Science, vol. 343, No. 6166, Jan. 3, 2014, 10 pages.
Shalem et al., "High-Throughput Functional Genomics Using CRISPR-Cas9", Nature Reviews Genetics, vol. 16, No. 5, May 2015, 28 pages.
Shan et al., "Targeted Genome Modification of Crop Plants Using a CRISPR-Cas System", Nature biotechnology, vol. 31, No. 8, Aug. 2013, 686-688.
Sharma et al., "Antisense Oligonucleotides: Modifications and Clinical Trials", MedChemComm, vol. 5, Jul. 29, 2014, 1454-1471.
Shmakov et al., "Discovery and Functional Characterization of Diverse Class 2 CRISPR-Cas Systems", Molecular Cell, vol. 60, No. 3, Nov. 5, 2015, 385-397.
Shmakov et al., "Diversity and Evolution of Class 2 CRISPR-Cas Systems", Nature Reviews Microbiology, vol. 15, No. 3, Mar. 2017, 30 pages.
Stovicek et al., "CRISPR-Cas System Enables Fast and Simple Genome Editing of Industrial *Saccharomyces cerevisiae* Strains", Metabolic Engineering Communications, vol. 2, Dec. 2015, 13-22.
Sugano et al., "CRISPR/Cas9-Mediated Targeted Mutagenesis in the Liverwort *Marchantia polymorpha* L.", Plant and Cell Physiology, vol. 55, No. 3, Mar. 2014, 475-481.
Swiech et al., "In Vivo Interrogation of Gene Function in the Mammalian Brain Using CRISPR-Cas9", Nature Biotechnology, vol. 33, No. 1, Jan. 2015, 102-106.
Tsai et al., "Dimeric CRISPR RNA-Guided FokI Nucleases for Highly Specific Genome Editing", Nature Biotechnology, vol. 32, No. 6, Jun. 2014, 569-576.
Vogel et al., "Improving Site-Directed RNA Editing In Vitro and in Cell Culture by Chemical Modification of the GuideRNA", Angewandte Chemie International Edition in English, vol. 53, No. 24, Jun. 10, 2014, 6267-6271.
Wang et al., "A Phenotypic Screen for Functional Mutants of Human Adenosine Deaminase Acting on RNA 1", ACS Chemical Biology, vol. 10, No. 11, Nov. 20, 2015, 20 pages.
Wang et al., "Genetic Screens in Human Cells Using the CRISPR/Cas9 System", Science, vol. 343, No. 6166, Jan. 3, 2014, 12 pages.
Wang et al., "One-Step Generation of Mice Carrying Mutations in Multiple Genes by CRISPR/Cas-Mediated Genome Engineering", Cell, vol. 153, No. 4, May 9, 2013, 13 pages.
Wettengel et al., "Harnessing Human ADAR2 for RNA Repair—Recoding a PINK1 Mutation Rescues Mitophagy", Nucleic Acids Research, vol. 45, No. 5, Oct. 7, 2016, 2797-2808.
Wong et al., "Substrate Recognition by ADAR1 and ADAR2", RNA, vol. 7, No. 6, Jun. 2001, 846-858.
Woo et al., "DNA-Free Genome Editing in Plants with Preassembled CRISPR-Cas9 Ribonucleoproteins", Nature Biotechnology, vol. 33, No. 11, Nov. 2015, 1162-1164.
Wu et al., "Genome-Wide Binding of the CRISPR Endonuclease Cas9 in Mammalian Cells", Nature Biotechnology, vol. 32, No. 7, Jul. 2014, 670-676.
Xie et al., "RNA-Guided Genome Editing in Plants Using a CRISPR-Cas System", Molecular Plant, vol. 6, No. 6, Nov. 2013, 1975-1983.
Xing et al., "A CRISPR/Cas9 Toolkit for Multiplex Genome Editing in Plants", BMC Plant Biology, vol. 14, No. 327, 2014, 12 pages.
Zheng et al., "DNA Editing in DNA/RNA Hybrids by Adenosine Deaminases that Act on RNA", Nucleic Acids Research, vol. 45, No. 6, Jan. 28, 2017, 3369-3377.
Examination Report from corresponding Indian application No. 201917044711 dated Dec. 30, 2020; all enclosed pages cited.
Office Action from corresponding Israeli application No. 269941 dated Dec. 8, 2022, all enclosed pages cited.
Smargon, et al., "Cas13b is a type of VI-B Crispr-associated RNA-Guided RNAse differentially regulated by accessory proteins Csx27 and Csx28," Mol Cell. Feb. 16, 2017; 65(4); all enclosed pages cited.
Office Action from corresponding Japanese application No. 2019-555810 dated Sep. 6, 2022, all enclosed pages cited.
Office Action from corresponding Chinese application No. 201880038907.3 dated Feb. 27, 2023 all enclosed pages cited.
Search Report from corresponding Chinese application No. 201880038907.3 dated Feb. 27, 2023 all enclosed pages cited.

* cited by examiner

FIG 1

1      WP_002664492 Bergeyella zoohelcum

MENKTSLGNNIYYNPFKPQDKSYFAGYFNAAMENTDSVFRELGKRLKGKEYTSENFFDAIFKENISLVEYERYV
KLLSDYFPMARLLDKKEVPIKERKENFKKNFKGIIKAVRDLRNFYTHKEHGEVEITDEIFGVLDEMLKSTVLTVKKKKVKTD
KTKEILKKSIEKQLDILCQKKLEYLRDTARKIEEKRRNQRERGEKELVAPFKYSDKRDDLIAAIYNDAFDVYIDKKKDSLKESS
KAKYNTKSDPQQEEGDLKIPISKNGVVFLLSLFLTKQEIHAFKSKIAGFKATVIDEATVSEATVSHGKNSICFMATHEIFSHL
AYKKLKRKVRTAEINYGEAENAEQLSVYAKETLMMQMLDELSKVPDVVYQNLSEDVQKTFIEDWNEYLKENNGDVGT
MEEEQVIHPVIRKRYEDKFNYFAIRFLDEFAQFPTLRFQVHLGNYLHDSRPKENLISDRRIKEKITVFGRLSELEHKKALFIK
NTETNEDREHYWEIFPNPNYDFPKENISVNDKDFPIAGSILDREKQPVAGKIGIKVKLLNQQYVSEVDKAVKAHQLKQRK
ASKPSIQNIIEEIVPINESNPKEAIVFGGQPTAYLSMNDIHSILYEFFDKWEKKKEKLEKKGEKELRKEIGKELEKKIVGKIQA
QIQQIIDKDTNAKILKPYQDGNSTAIDKEKLIKDLKQEQNILQKLKDEQTVREKEYNDFIAYQDKNREINKVRDRNHKQYL
KDNLKRKYPEAPARKEVLYYREKGKVAVWLANDIKRFMPTDFKNEWKGEQHSLLQKSLAYYEQCKEELKNLLPEKVFQ
HLPFKLGGYFQQKYLYQFYTCYLDKRLEYISGLVQQAENFKSENKVFKKVENECFKFLKKQNYTHKELDARVQSILGYPIFL
ERGFMDEKPTIIKGKTFKGNEALFADWFRYYKEYQNFQTFYDTENYPLVELEKKQADRKRKTKIYQQKKNDVFTLLMAK
HIFKSVFKQDSIDQFSLEDLYQSREERLGNQERARQTGERNTNYIWNKTVDLKLCDGKITVENVKLKNVGDFIKYEYDQR
VQQAFLKYEENIEWQAFLIKESKEEENYPYVVEREIEQYEKVRREELLKEVHLIEEYILEKVKDKEILKKGDNQNFKYYILNGLL
KQLKNEDVESYKVFNLNTEPEDVNINQLKQEATDLEQKAFVLTYIRNKFAHNQLPKKEFWDYCQEKYGKIEKEKTYAEYF
AEVFKKEKEALIK    SEQ ID NO: 146

2      WP_036860899 Prevotella intermedia

MEDDKKTTDSIRYELKDKHFWAAFLNLARHNVYITVNHINKILEEGEINRDGYETTLKNTWNEIKDINKKDRLS
KLIIKHFPFLEAATYRLNPTDTTKQKEEKQAEAQSLESLRKSFFVFIYKLRDLRNHYSHYKHSKSLERPKFEEGLLEKMYNIF
NASIRLVKEDYQYNKDINPDEDFKHLDRTEEEFNYYFTKDNEGNITESGLLFFVSLFLEKKDAIWMQQKLRGFKDNRENK
KKMTNEVFCRSRMLLPKLRLQSTQTQDWILLDMLNELIRCPKSLYERLREEDREKFRVPIEIADEDYDAEQEPFKNTLVR
HQDRFPYFALRYFDYNEIFTNLRFQIDLGTYHFSIYKKQIGDYKESHHLTHKLYGFERIQEFTKQNRPDEWRKFVKTFNSF
ETSKEPYIPETTPHYHLENQKIGIRFRNDNDKIWPSLKTNSEKNEKSKYKLDKSFQAEAFLSVHELLPMMFYYLLLKTENTD
NDNEIETKKKENKNDKQEKHKIEEIIENKITEIYALYDTFANGEIKSIDELEEYCKGKDIEIGHLPKQMIAILKDEHKVMATEA
ERKQEEMLVDVQKSLESLDNQINEEIENVERKNSSLKSGKIASWLVNDMMRFQPVQKDNEGKPLNNSKANSTEYQLL
QRTLAFFGSEHERLAPYFKQTKLIESSNPHPFLKDTEWEKCNNILSFYRSYLEAKKNFLESLKPEDWEKNQYFLKLKEPKTK
PKTLVQGWKNGFNLPRGIFTEPIRKWFMKHRENITVAELKRVGLVAKVIPLFFSEEYKDSVQPFYNYHFNVGNINKPDE
KNFLNCEERRELLRKKKDEFKKMTDKEKEENPSYLEFKSWNKFERELRLVRNQDIVTWLLCMELFNKKKIKELNVEKIYLK
NINTNTTKKEKNTEEKNGEEKNIKEKNNILNRIMPMRLPIKVYGRENFSKNKKKKIRRNTFFTVYIEEKGTKLLKQGNFKAL
ERDRRLGGLFSFVKTPSKAESKSNTISKLRVEYELGEYQKARIEIIKDMLALEKTLIDKYNSLDTDNFKMLTDWLELKGEP
DKASFQNDVDLLIAVRNAFSHNQYPMRNRIAFANINPFSLSSANTSEEKGLGIANQLKDKTHKTIEKIIEIEKPIETKE
SEQ ID NO: 147

3      WP_004343973 Prevotella buccae

MQKQDKLFVDRKKNAIFAFPKYITIMENKEKPEPIYYELTDKHFWAAFLNLARHNVYTTINHINRRLEIAELKDD
GYMMGIKGSWNEQAKKLDKKVRLRDLIMKHFPFLEAAAYEMTNSKSPNNKEQREKEQSEALSLNNLKNVLFIFLEKLQ
VLRNYYSHYKYSEESPKPIFETSLLKNMYKVFDANVRLVKRDYMHHENIDMQRDFTHLNRKKQVGRTKNIIDSPNFHYH
FADKEGNMTIAGLLFFVSLFLDKKDAIWMQKKLKGFKDGRNLREQMTNEVFCRSRISLPKLKLENVQTKDWMQLDML
NELVRCPKSLYERLREKDRESFKVPFDIFSDDYNAEEEPFKNTLVRHQDRFPYFVLRYFDLNEIFEQLRFQIDLGTYHFSIYN

FIG 1 *(Continued)*

KRIGDEDEVRHLTHHHLYGFARIQDFAPQNQPEEWRKLVKDLDHFETSQEPYISKTAPHYHLENEKIGIKFCSAHNNLFPSL
QTDKTCNGRSKFNLGTQFTAEAFLSVHELLPMMFYYLLLTKDYSRKESADKVEGIIRKEISNIYAIYDAFANNEINSIADLTR
RLQNTNILQGHLPKQMISILKGRQKDMGKEAERKIGEMIDDTQRRLDLLCKQTNQKIRIGKRNAGLLKSGKIADWLVND
MMRFQPVQKDQNNIPINNSKANSTEYRMLQRALALFGSENFRLKAYFNQMNLVGNDNPHPFLAETQWEHQTNILSF
YRNYLEARKKYLKGLKPQNWKQYQHFLILKVQKTNRNTLVTGWKNSFNLPRGIFTQPIREWFEKHNNSKRIYDQILSFD
RVGFVAKAIPLYFAEEYKDNVQPFYDYPFNIGNRLKPKKRQFLDKKERVELWQKNKELFKNYPSEKKKTDLAYLDFLSWK
KFERELRLIKNQDIVTWLMFKELFNMATVEGLKIGEIHLRDIDTNTANEESNNILNRIMPMKLPVKTYETDNKGNILKERP
LATFYIEETETKVLKQGNFKALVKDRRLNGLFSFAETTDLNLEEHPISKLSVDLELIKYQTTRISIFEMTLGLEKKLIDKYSTLP
TDSFRNMLERWLQCKANRPELKNYVNSLIAVRNAFSHNQYPMYDATLFAEVKKFTLFPSVDTKKIELNIAPQLLEIVGKA
IKEIEKSENKN SEQ ID NO: 148

4      WP_012458151 Porphyromonas gingivalis
MNTVPASENKGQSRTVEDDPQYFGLYLNLARENLIEVESHVRIKFGKKKLNEESLKQSLLCDHLLSVDRWTKVY
GHSRRYLPFLHYFDPDSQIEKDHDSKTGVDPDSAQRLIRELYSLLDFLRNDFSHNRLDGTTFEHLEVSPDISSFITGTYSLAC
GRAQSRFAVFFKPDDFVLAKNRKEQLISVADGKECLTVSGFAFFICLFLDREQASGMLSRIRGFKRTDENWARAVHETFC
DLCIRHPHDRLESSNTKEALLLDMLNELNRCPRILYDMLPEEERAQFLPALDENSMNNLSENSLDEESRLLWDGSSDWA
EALTKRIRHQDRFPYLMLRFIEEMDLLKGIRFRVDLGEIELDSYSKKVGRNGEYDRTITDHALAFGKLSDFQNEEEVSRMI
SGEASYPVRFSLFAPRYAIYDNKIGYCHTSDPVYPKSKTGEKRALSNPQSMGFISVHDLRKLLLMELLCEGSFSRMQSDFL
RKANRILDETAEGKLQFSALFPEMRHRFIPPQNPKSKDRREKAETTLEKYKQEIKGRKDKLNSQLLSAFDMDQRQLPSRL
LDEWMNIRPASHSVKLRTYVKQLNEDCRLRLRKFRKDGDGKARAIPLVGEMATFLSQDIVRMIISEETKKLITSAYYNEM
QRSLAQYAGEENRRQFRAIVAELRLLDPSSGHPFLSATMETAHRYTEGFYKCYLEKKREWLAKIFYRPEQDENTKRRISVF
FVPDGEARKLLPLLIRRRMKEQNDLQDWIRNKQAHPIDLPSHLFDSKVMELLKVKDGKKKWNEAFKDWWSTKYPDG
MQPFYGLRRELNIHGKSVSYIPSDGKKFADCYTHLMEKTVRDKKRELRTAGKPVPPDLAADIKRSFHRAVNEREFMLRL
VQEDDRLMLMAINKMMTDREEDILPGLKNIDSILDEENQFSLAVHAKVLEKEGEGGDNSLSLVPATIEIKSKRKDWSKYI
RYRYDRRVPGLMSHFPEHKATLDEVKTLLGEYDRCRIKIFDWAFALEGAIMSDRDLKPYLHESSSREGKSGEHSTLVKML
VEKKGCLTPDESQYLILIRNKAAHNQFPCAAEMPLIYRDVSAKVGSIEGSSAKDLPEGSSLVDSLWKKYEMIIRKILPILDPE
NRFFGKLLNNMSQPINDL SEQ ID NO: 149

5      WP_034542281 Bacteroides pyogenes
MESIKNSQKSTGKTLQKDPPYFGLYLNMALLNVRKVENHIRKWLGDVALLPEKSGFHSLLTTDNLSSAKWTRF
YYKSRKFLPFLEMFDSDKKSYENRRETAECLDTIDRQKISSLLKEVYGKLQDIRNAFSHYHIDDQSVKHTALIISSEMHRFIE
NAYSFALQKTRARFTGVFVETDFLQAEEKGDNKKFFAIGGNEGIKLKDNALIFLICLFLDREEAFKFLSRATGFKSTKEKGFL
AVRETFCALCCRQPHERLLSVNPREALLMDMLNELNRCPDILFEMLDEKDQKSFLPLLGEEEQAHILENSLNDELCEAID
DPFEMIASLSKRVRYKNRFPYLMLRYIEEKNLLPFIRFRIDLGCLELASYPKKMGEENNYERSVTDHAMAFGRLTDFHNE
DAVLQQITKGITDEVRFSLYAPRYAIYNNKIGFVRTSGSDKISFPTLKKKGGEGHCVAYTLQNTKSFGFISIYDLRKILLLSFL
DKDKAKNIVSGLLEQCEKHWKDLSENLFDAIRTELQKEFPVPLIRYTLPRSKGGKLVSSKLADKQEKYESEFERRKEKLTEIL
SEKDFDLSQIPRRMIDEWLNVLPTSREKKLKGYVETLKLDCRERLRVFEKREKGEHPLPPRIGEMATDLAKDIIRMVIDQG
VKQRITSAYYSEIQRCLAQYAGDDNRRHLDSIIRELRLKDTKNGHPFLGKVLRPGLGHTEKLYQRYFEEKKEWLEATFYPA
ASPKRVPRFVNPPTGKQKELPLIIRNLMKERPEWRDWKQRKNSHPIDLPSQLFENEICRLLKDKIGKEPSGKLKWNEMF
KLYWDKEFPNGMQRFYRCKRRVEVFDKVVEYEYSEEGGNYKKYYEALIDEVVRQKISSSKEKSKLQVEDLTLSVRRVFKR

FIG 1 *(Continued)*

AINEKEYQLRLLCEDDRLLFMAVRDLYDWKEAQLDLDKIDNMLGEPVSVSQVIQLEGGQPDAVIKAECKLKDVSKLMRY
CYDGRVKGLMPYFANHEATQEQVEMELRHYEDHRRRVFNWVFALEKSVLKNEKLRRFYEESQGGCEHRRCIDALRKA
SLVSEEEYEFLVHIRNKSAHNQFPDLEIGKLPPNVTSGFCECIWSKYKAIICRIIPFIDPERRFFGKLLEQK SEQ ID NO: 150

6     WP_047447901   Alistipes sp. ZOR0009

MSNEIGAFREHQFAYAPGNEKQEEATFATYFNLALSNVEGMMFGEVESNPDKIEKSLDTLPPAILRQIASFIWL
SKEDHPDKAYSTEEVKVIVTDLVRRLCFYRNYFSHCFYLDTQYFYSDELVDTTAIGEKLPYNFHHFITNRLFRYSLPEITLFR
WNEGERKYEILRDGLIFFCCLFLKRGQAERFLNELRFFKRTDEEGRIKRTIFTKYCTRESHKHIGIEEQDFLIFQDIIGDLNRV
PKVCDGVVDLSKENERYIKNRETSNESDENKARYRLLIREKDKFPYYLMRYIVDFGVLPCITFKQNDYSTKEGRGQFHYQ
DAAVAQEERCYNFVVRNGNVYYSYMPQAQNVVRISELQGTISVEELRNMVYASINGKDVNKSVEQYLYHLHLLYEKILT
ISGQTIKEGRVDVEDYRPLLDKLLLRPASNGEELRRELRKLLPKRVCDLLSNRFDCSEGVSAVEKRLKAILLRHEQLLLSQNP
ALHIDKIKSVIDYLYLFFSDDEKFRQQPTEKAHRGLKDEEFQMYHYLVGDYDSHPLALWKELEASGRLKPEMRKLTSATSL
HGLYMLCLKGTVEWCRKQLMSIGKGTAKVEAIADRVGLKLYDKLKEYTPEQLEREVKLVVMHGYAAAATPKPKAQAAI
PSKLTELRFYSFLGKREMSFAAFIRQDKKAQKLWLRNFYTVENIKTLQKRQAAADAACKKLYNLVGEVERVHTNDKVLVL
VAQRYRERLLNVGSKCAVTLDNPERQQKLADVYEVQNAWLSIRFDDLDFTLTHVNLSNLRKAYNLIPRKHILAFKEYLDN
RVKQKLCEECRNVRRKEDLCTCCSPRYSNLTSWLKENHSESSIEREAATMMLLDVERKLLSFLLDERRKAIIEYGKFIPFSA
LVKECRLADAGLCGIRNDVLHDNVISYADAIGKLSAYFPKEASEAVEYIRRTKEVREQRREELMANSSQ SEQ ID NO: 151

7     WP_036929175   Prevotella sp. MA2016

MSKECKKQRQEKKRRLQKANFSISLTGKHVFGAYFNMARTNFVKTINYILPIAGVRGNYSENQINKMLHALFLI
QAGRNEELTTEQKQWEKKLRLNPEQQTKFQKLLFKHFPVLGPMMADVADHKAYLNKKKSTVQTEDETFAMLKGVSL
ADCLDIICLMADTLTECRNFYTHKDPYNKPSQLADQYLHQEMIAKKLDKVVVASRRILKDREGLSVNEVEFLTGIDHLHQ
EVLKDEFGNAKVKDGKVMKTFVEYDDFYFKISGKRLVNGYTVTTKDDKPVNVNTMLPALSDFGLLYFCVLFLSKPYAKLF
IDEVRLFEYSPFDDKENMIMSEMLSIYRIRTPRLHKIDSHDSKATLAMDIFGELRRCPMELYNLLDKNAGQPFFHDEVKH
PNSHTPDVSKRLRYDDRFPTLALRYIDETELFKRIRFQLQLGSFRYKFYDKENCIDGRVRVRRIQKEINGYGRMQEVADKR
MDKWGDLIQKREERSVKLEHEELYINLDQFLEDTADSTPYVTDRRPAYNIHANRIGLYWEDSQNPKQYKVFDENGMYI
PELVVTEDKKAPIKMPAPRCALSVYDLPAMLFYEYLREQQDNEFPSAEQVIIEYEDDYRKFFKAVAEGKLKPFKRPKEFRD
FLKKEYPKLRMADIPKKLQLFLCSHGLCYNNKPETVYERLDRLTLQHLEERELHIQNRLEHYQKDRDMIGNKDNQYGKKS
FSDVRHGALARYLAQSMMEWQPTKLKDKEKGHDKLTGLNYNVLTAYLATYGHPQVPEEGFTPRTLEQVLINAHLIGGS
NPHPFINKVLALGNRNIEELYLHYLEEELKHIRSRIQSLSSNPSDKALSALPFIHHDRMRYHERTSEEMMALAARYTTIQLP
DGLFTPYILEILQKHYTENSDLQNALSQDVPVKLNPTCNAAYLITLFYQTVLKDNAQPFYLSDKTYTRNKDGEKAESFSFK
RAYELFSVLNNNKKDTFPFEMIPLFLTSDEIQERLSAKLLDGDGNPVPEVGEKGKPATDSQGNTIWKRRIYSEVDDYAEK
LTDRDMKISFKGEWEKLPRWKQDKIIKRRDETRRQMRDELLQRMPRYIRDIKDNERTLRRYKTQDMVLFLLAEKMFTN
IISEQSSEFNWKQMRLSKVCNEAFLRQTLTFRVPVTVGETTIYVEQENMSLKNYGEFYRFLTDDRLMSLLNNIVETLKPN
ENGDLVIRHTDLMSELAAYDQYRSTIFMLIQSIENLIITNNAVLDDPDADGFWVREDLPKRNNFASLLELINQLNNVELT
DDERKLLVAIRNAFSHNSYNIDFSLIKDVKHLPEVAKGILQHLQSMLGVEITK SEQ ID NO: 152

8     WP_004919755   Riemerella anatipestifer

MEKPLLPNVYTLKHKFFWGAFLNIARHNAFITICHINEQLGLKTPSNDDKIVDVVCETWNNILNNDHDLLKKS
QLTELILKHFPFLTAMCYHPPKKEGKKKGHQKEQQKEKESEAQSQAEALNPSKLIEALEILVNQLHSLRNYYSHYKHKKPD
AEKDIFKHLYKAFDASLRMVKEDYKAHFTVNLTRDFAHLNRKGKNKQDNPDFNRYRFEKDGFFTESGLLFFTNLFLDKR

FIG 1 *(Continued)*

DAYWMLKKVSGFKASHKQREKMTTEVFCRSRILLPKLRLESRYDHNQMLLDMLSELSRCPKLLYEKLSEENKKHFQVEA
DGFLDEIEEEQNPFKDTLIRHQDRFPYFALRYLDLNESFKSIRFQVDLGTYHYCIYDKKIGDEQEKRHLTRTLLSFGRLQDFT
EINRPQEWKALTKDLDYKETSNQPFISKTTPHYHITDNKIGFRLGTSKELYPSLEIKDGANRIAKYPYNSGFVAHAFISVHEL
LPLMFYQHLTGKSEDLLKETVRHIQRIYKDFEEERINTIEDLEKANQGRLPLGAFPKQMLGLLQNKQPDLSEKAKIKIEKLI
AETKLLSHRLNTKLKSSPKLGKRREKLIKTGVLADWLVKDFMRFQPVAYDAQNQPIKSSKANSTEFWFIRRALALYGGEK
NRLEGYFKQTNLIGNTNPHPFLNKFNWKACRNLVDFYQQYLEQREKFLEAIKNQPWEPYQYCLLLKIPKENRKNLVKG
WEQGGISLPRGLFTEAIRETLSEDLMLSKPIRKEIKKHGRVGFISRAITLYFKEKYQDKHQSFYNLSYKLEAKAPLLKREEHY
EYWQQNKPQSPTESQRLELHTSDRWKDYLLYKRWQHLEKKLRLYRNQDVMLWLMTLELTKNHFKELNLNYHQLKLE
NLAVNVQEADAKLNPLNQTLPMVLPVKVYPATAFGEVQYHKTPIRTVYIREEHTKALKMGNFKALVKDRRLNGLFSFIK
EENDTQKHPISQLRLRRELEIYQSLRVDAFKETLSLEEKLLNKHTSLSSLENEFRALLEEWKKEYAASSMVTDEHIAFIASVR
NAFCHNQYPFYKEALHAPIPLFTVAQPTTEEKDGLGIAEALLKVLREYCEIVKSQI   SEQ ID NO: 153

9       WP_025000926 Prevotella aurantiaca
MEDDKKTTGSISYELKDKHFWAAFLNLARHNVYITINHINKLLEIREIDNDEKVLDIKTLWQKGNKDLNQKARL
RELMTKHFPFLETAIYTKNKEDKKEVKQEKQAEAQSLESLKDCLFLFLDKLQEARNYYSHYKYSEFSKEPEFEEGLLEKMY
NIFGNNIQLVINDYQHNKDINPDEDFKHLDRKGQFKYSFADNEGNITESGLLFFVSLFLEKKDAIWMQQKLNGFKDNLE
NKKKMTHEVFCRSRILMPKLRLESTQTQDWILLDMLNELIRCPKSLYERLQGDDREKFKVPFDPADEDYNAEQEPFKNT
LIRHQDRFPYFVLRYFDYNEIFKNLRFQIDLGTYHFSIYKKLIGGQKEDRHLTHKLYGFERIQEFAKQNRPDEWKAIVKDLD
TYETSNKRYISETTPHYHLENQKIGIRFRNGNKEIWPSLKTNDENNEKSKYKLDKQYQAEAFLSVHELLPMMFYYLLLKKE
KPNNDEINASIVEGFIKREIRNIFKLYDAFANGEINNIDDLEKYCADKGIPKRHLPKQMVAILYDEHKDMVKEAKRKQKE
MVKDTKKLLATLEKQTQKEKEDDGRNVKLLKSGEIARWLVNDMMRFQPVQKDNEGKPLNNSKANSTEYQMLQRSLA
LYNNEEKPTRYFRQVNLIESNNPHPFLKWTKWEECNNILTFYYSYLTKKIEFLNKLKPEDWKKNQYFLKLKEPKTNRETLV
QGWKNGFNLPRGIFTEPIREWFKRHQNNSKEYEKVEALDRVGLVTKVIPLFFKEEYFKDKEENFKEDTQKEINDCVQPFY
NFPYNVGNIHKPKEKDFLHREERIELWDKKKDKFKGYKEKIKSKKLTEKDKEEFRSYLEFQSWNKFERELRLVRNQDIVT
WLLCKELIDKLKIDELNIEELKKLRLNNIDTDTAKKEKNNILNRVMPMELPVTVYEIDDSHKIVDKPLHTIYIKEAETKLLK
QGNFKALVKDRRLNGLFSFVKTNSEAESKRNPISKLRVEYELGEYQEARIEHQDMLALEEKLINKYKDLPTNKFSEMLNS
WLEGKDEADKARFQNDVDFLIAVRNAFSHNQYPMHNKIEFANIKPFSLYTANNSEEKGLGIANQLKDKTKETTDKIKKIE
KPIETKE   SEQ ID NO: 154

10      WP_051522484 Prevotella saccharolytica
MEDKPFWAAFFNLARHNVYLTVNHINKLLDLEKLYDEGKHKEIFEREDIFNISDDVMNDANSNGKKRKLDIKKI
WDDLDTDLTRKYQLRELILKHFPFIQPAIIGAQTKERTTIDKDKRSTSTSNDSLKQTGEGDINDLLSLSNVKSMFFRLLQILE
QLRNYYSHVKHSKSATMPNFDEDLLNWMRYIFIDSVNKVKEDYSSNSVIDPNTSFSHLIYKDEQGKIKPCRYPFTSKDGSI
NAFGLLFFVSLFLEKQDSIWMQKKIPGFKKASENYMKMTNEVFCRNHILLPKIRLETVYDKDWMLLDMLNEVVRCPLSL
YKRLTPAAQNKFKVPEKSSDNANRQEDDNPFSRILVRHQNRFPYFVLRFFDLNEVFTTLRFQINLGCYHFAICKKQIGDK
KEVHHLIRTLYGFSRLQNFTQNTRPEEWNTLVKTTEPSSGNDGKTVQGVPLPYISYTIPHYQIENEKIGIKIFDGDTAVDT
DIWPSVSTEKQLNKPDKYTLTPGFKADVFLSVHELLPMMFYYQLLLCEGMLKTDAGNAVEKVLIDTRNAIFNLYDAFVQ
EKINTITDLENYLQDKPILIGHLPKQMIDLLKGHQRDMLKAVEQKKAMLIKDTERRLKLLDKQLKQETDVAAKNTGTLLK
NGQIADWLVNDMMRFQPVKRDKEGNPINCSKANSTEYQMLQRAFAFYATDSCRLSRYFTQLHLIHSDNSHLFLSRFEY
DKQPNLIAFYAAYLKAKLEFLNELQPQNWASDNYFLLLRAPKNDRQKLAEGWKNGFNLPRGLFTEKIKTWFNEHKTIVD

FIG 1 *(Continued)*

ISDCDIFKNRVGQVARLIPVFFDKKFKDHSQPFYRYDFNVGNVSKPTEANYLSKGKREELFKSYQNKFKNNIPAEKTKEYR
EYKNFSLWKKFERELRLIKNQDILIWLMCKNLFDEKIKPKKDILEPRIAVSYIKLDSLQTNTSTAGSLNALAKVVPMTLAIHI
DSPKPKGKAGNNEKENKEFTVYIKEEGTKLLKWGNFKTLLADRRIKGLFSYIEHDDIDLKQHPLTKRRVDLELDLYQTCRID
IFQQTLGLEAQLLDKYSDLNTDNFYQMLIGWRKKEGIPRNIKEDTDFLKDVRNAFSHNQYPDSKKIAFRRIRKFNPKELIL
EEEEGLGIATQMYKEVEKVVNRIKRIELFD   SEQ ID NO: 155

11   EHO06562   *Myroides odoratimimus* CCUG 10230
MKDILTTDTTEKQNRFYSHKIADKYFFGGYFNLASNNIYEVFEEVNKRNTFGKLAKRDNGNLKNYIIHVFKDELS
ISDFEKRVAIFASYFPILETVDKKSIKERNRTIDLTLSQRIRQFREMLISLVTAVDQLRNFYTHYHHSDIVIENKVLDFLNSSFV
STALHVKDKYLKTDKTKEFLKETIAAELDILIEAYKKKQIEKKNTRFKANKREDILNAIYNEAFWSFINDKDKDKDKETVVAK
GADAYFEKNHHKSNDPDFALNISEKGIVYLLSFFLTNKEMDSLKANLTGFKGKVDRESGNSIKYMATQRIYSFHTYRGLK
QKIRTSEEGVKETLLMQMIDELSKVPNVVYQHLSTTQQNSFIEDWNEYYKDYEDDVETDDLSRVIHPVIRKRYEDRFNYF
AIRFLDEFFDFPTLRFQVHLGDYVHDRRTKQLGKVESDRIIKEKVTVFARLKDINSAKASYFHSLEEQDKEELDNKWTLFP
NPSYDFPKEHTLQHQGEQKNAGKIGIYVKLRDTQYKEKAALEEARKSLNPKERSATKASKYDIITQIIEANDNVKSEKPLVF
TGQPIAYLSMNDIHSMLFSLLTDNAELKKTPEEVEAKLIDQIGKQINEILSKDTDTKILKKYKDNDLKETDTDKITRDLARDK
EEIEKLILEQKQRADDYNYTSSTKFNIDKSRKRKHLLFNAEKGKIGVWLANDIKRFMFKESKSKWKGYQHTELQKLFAYFD
TSKSDLELILSNMVMVKDYPIELIDLVKKSRTLVDFLNKYLEARLEYIENVITRVKNSIGTPQFKTVRKECFTFLKKSNYTVVS
LDKQVERILSMPLFIERGFMDDKPTMLEGKSYKQHKEKFADWFVHYKENSNYQNFYDTEVYEITTEDKREKAKVTKKIK
QQQKNDVFTLMMVNYMLEEVLKLSSNDRLSLNELYQTKEERIVNKQVAKDTQERNKNYIWNKVVDLQLCDGLVHIDN
VKLKDIGNFRKYENDSRVKEFLTYQSDIVWSAYLSNEVDSNKLYVIERQLDNYESIRSKELLKEVQEIECSVYNQVANKESL
KQSGNENFKQYVLQGLLPIGMDVREMLILSTDVKFKKEEIIQLGQAGEVEQDLYSLIYIRNKFAHNQLPIKEFFDFCENNY
RSISDNEYYAEYYMEIFRSIKEKYAN   SEQ ID NO: 156

12   WP_061868553   *Prevotella intermedia*
MEDDKKTTDSIRYELKDKHFWAAFLNLARHNVYITVNHINKILEEDEINRDGYENTLENSWNEIKDINKKDRLS
KLIIKHFPFLEATTYRQNPTDTTKQKEEKQAEAQSLESLKKSFFVFIYKLRDLRNHYSHYKHSKSLERPKFEEDLQNKMYNIF
DVSIQFVKEDYKHNTDINPKKDFKHLDRKRKGKFHYSFADNEGNITESGLLFFVSLFLEKKDAIWVQKKLEGFKCSNKSYQ
KMTNEVFCRSRMLLPKLRLESTQTQDWILLDMLNELIRCPKSLYERLQGVNRKKFYVSFDPADEDYDAEQEPFKNTLVR
HQDRFPYFALRYFDYNEVFANLRFQIDLGTYHFSIYKKLIGGQKEDRHLTHKLYGFERIQEFDKQNRPDEWKAIVKDSDT
FKKKEEKEEEKPYISETTPHYHLENKKIGIAFKNHNIWPSTQTELTNNKRKKYNLGTSIKAEAFLSVHELLPMMFYYLLLKTE
NTKNDNKVGGKKETKKQGKHKIEAIIESKIKDIYALYDAFANGEINSEDELKEYLKGKDIKIVHLPKQMIAILKNEHKDMAE
KAEAKQEKMKLATENRLKTLDKQLKGKIQNGKRYNSAPKSGEIASWLVNDMMRFQPVQKDENGESLNNSKANSTEY
QLLQRTLAFFGSEHERLAPYFKQTKLIESSNPHPFLNDTEWEKCSNILSFYRSYLKARKNFLESLKPEDWEKNQYFLMLKE
PKTNRETLVQGWKNGFNLPRGFFTEPIRKWFMEHWKSIKVDDLKRVGLVAKVTPLFFSEKYKDSVQPFYNYPFNVGDV
NKPKEEDFLHREERIELWDKKKDKFKGYKAKKKFKEMTDKEKEEHRSYLEFQSWNKFERELRLVRNQDIVTWLLCTELID
KLKIDELNIKELKKLRLKDINTDTAKKEKNNILNRVMPMELPVTVYKVNKGGYIIKNKPLHTIYIKEAETKLLKQGNFKALVK
DRRLNGLFSFVKTPSEAESESNPISKLRVEYELGKYQNARLDIIEDMLALEKKLIDKYNSLDTDNFHNMLTGWLELKGEAK
KARFQNDVKLLTAVRNAFSHNQYPMYDENLFGNIERFSLSSSNIIESKGLDIAAKLKEEVSKAAKKIQNEEDNKKEKET
SEQ ID NO: 157

13   WP_013997271   *Capnocytophaga canimorsus*
MKNIQRLGKGNEFSPFKKEDKFYFGGFLNLANNNIEDFFKEIITRFGIVITDENKKPKETFGEKILNEIFKKDISIVD

FIG 1 *(Continued)*

YEKWVNIFADYFPFTKYLSLYLEEMQFKNRVICFRDVMKELLKTVEALRNFYTHYDHEPIKIEDRVFYFLDKVLLDVSLTVK
NKYLKTDKTKEFLNQHIGEELKELCKQRKDYLVGKGKRIDKESEIINGIYNNAFKDFICKREKQDDKENHNSVEKILCNKEP
QNKKQKSSATVWELCSKSSSKYTEKSFPNRENDKHCLEVPISQKGIVFLLSFFLNKGEIYALTSNIKGFKAKITKEEPVTYDK
NSIRYMATHRMFSFLAYKGLKRKIRTSEINYNEDGQASSTYEKETLMLQMLDELNKVPDVVYQNLSEDVQKTFIEDWNE
YLKENNGDVGTMEEEQVIHPVIRKRYEDKFNYFAIRFLDEFAQFPTLRFQVHLGNYLCDKRTKQICDTTTEREVKKKITVF
GRLSELENKKAIFLNEREEIKGWEVFPNPSYDFPKENISVNYKDFPIVGSILDREKQPVSNKIGIRVKIADELQREIDKAIKEK
KLRNPKNRKANQDEKQKERLVNEIVSTNSNEQGEPVVFIGQPTAYLSMNDIHSVLYEFLINKISGEALETKIVEKIETQIKQ
IIGKDATTKILKPYTNANSNSINREKLLRDLEQEQQILKTLLEEQQQREKDKKDKKSKRKHELYPSEKGKVAVWLANDIKRF
MPKAFKEQWRGYHHSLLQKYLAYYEQSKEELKNLLPKEVFKHFPFKLKGYFQQQYLNQFYTDYLKRRLSYVNELLLNIQN
FKNDKDALKATEKECFKFFRKQNYIINPINIQIQSILVYPIFLKRGFLDEKPTMIDREKFKENKDTELADWFMHYKNYKED
NYQKFYAYPLEKVEEKEKFKRNKQINKQKKNDVYTLMMVEYIIQKIFGDKFVEENPLVLKGIFQSKAERQQNNTHAATT
QERNLNGILNQPKDIKIQGKITVKGVKLKDIGNFRKYEIDQRVNTFLDYEPRKEWMAYLPNDWKEKEKQGQLPPNNVI
DRQISKYETVRSKILLKDVQELEKIISDEIKEEHRHDLKQGKYYNFKYYILNGLLRQLKNENVENYKVFKLNTNPEKVNITQL
KQEATDLEQKAFVLTYIRNKFAHNQLPKKEFWDYCQEKYGKIEKEKTYAEYFAEVFKREKEALIK   SEQ ID NO: 158

14    WP_039434803  Porphyromonas gulae
      MTEQSERPYNGTYYTLEDKHFWAAFLNLARHNAYITLTHIDRQLAYSKADITNDQDVLSFKALWKNFDNDLE
RKSRLRSLILKHFSFLEGAAYGKKLFESKSSGNKSSKNKELTKKEKEELQANALSLDNLKSILFDFLQKLKDFRNYYSHYRHS
GSSELPLFDGNMLQRLYNVFDVSVQRVKIDHEHNDEVDPHYHFNHLVRKGKKDRYGHNDNPSFKHHFVDGEGMVTE
AGLLFFVSLFLEKRDAIWMQKKIRGFKGGTETYQQMTNEVFCRSRISLPKLKLESLRMDDWMLLDMLNELVRCPKPLY
DRLREDDRACFRVPVDILPDEDDTGGGEDPFKNTLVRHQDRFPYFALRYFDLKKVFTSLRFHIDLGTYHFAIYKKMIGE
QPEDRHLTRNLYGFGRIQDFAEEHRPEEWKRLVRDLDYFETGDKPYISQTSPHYHIEKGKIGLRFMPEGQHLWPSPEVG
TTRTGRSKYAQDKRLTAEAFLSVHELMPMMFYYFLLREKYSEEVSAERVQGRIKRVIEDVYAVYDAFARDEINTRDELDA
CLADKGIRRGHLPRQMIAILSQEHKDMEEKIRKKLQEMMADTDHRLDMLDRQTDRKIRIGRKNAGLPKSGVIADWLV
RDMMRFQPVAKDASGKPLNNSKANSTEYRMLQRALALFGGEKERLTPYFRQMNLTGGNNPHPFLHETRWESHTNIL
SFYRSYLRARKAFLERIGRSDRVENRPFLLLKEPKTDRQTLVAGWKGEFHLPRGIFTEAVRDCLIEMGHDEVASYKEVGF
MAKAVPLYFERACEDRVQPFYDSPFNVGNSLKPKKGRFLSKEERAEEWERGKERFRDLEAWSYSAARRIEDAFAGIEYA
SPGNKKKIEQLLRDLSLWEAFESKLKVRADRINLAKLKKEILEAQEHPYHDFKSWQKFERELRLVKNQDIITWMMCRDL
MEEENKVEGLDTGTLYLKDIRPNVQEQGSLNVLNRVKPMRLPVVVYRADSRGHVHKEEAPLATVYIEERDTKLLKQGNF
KSFVKDRRLNGLFSFVDTGGLAMEQYPISKLRVEYELAKYQTARVCVFELTLRLEESLLTRYPHLPDESFREMLESWSDPL
LAKWPELHGKVRLLIAVRNAFSHNQYPMYDEAVFSSIRKYDPSSPDAIEERMGLNIAHRLSEEVKQAKETVERIIQA
SEQ ID NO: 159

15    WP_044065294  Prevotella sp. P5-125
      MNIPALVENQKKYFGTYSVMAMLNAQTVLDHIQKVADIEGEQNENNENLWFHPVMSHLYNAKNGYDKQP
EKTMFIIERLQSYPFFLKIMAENQREYSNGKYKQNRVEVNSNDIFEVLKRAFGVLKMYRDLTNHYKTYEEKLNDGCEFLT
STEQPLSGMINNYYTVALRNMNERYGYKTEDLAFIQDKRFKFVKDAYGKKKSQVNTGFFLSLQDYNGDTQKKLHLSGV
GIALLICLFLDKQYINIFLSRLPIFSSYNAQSEERRIIRSFGINSIKLPKDRIHSEKSNKSVAMDMLNEVKRCPDELFTTLSAEK
QSRFRIISDDHNEVLMKRSSDRFVPLLLQYIDYGKLFDHIRFHVNMGKLRYLLKADKTCIDGQTRVRVIEQPLNGFGRLEE
AETMRKQENGTFGNSGIRIRDFENMKRDDANPANYPYIVDTYTHYILENNKVEMFINDKEDSAPLLPVIEDDRYVVKTIP
SCRMSTLEIPAMAFHMFLFGSKKTEKLIVDVHNRYKRLFQAMQKEEVTAENIASFGIAESDLPQKILDLISGNAHGKDVD

FIG 1 *(Continued)*

AFIRLTVDDMLTDTERRIKRFKDDRKSIRSADNKMGKRGFKQISTGKLADFLAKDIVLFQPSVNDGENKITGLNYRIMQS
AIAVYDSGDDYEAKQQFKLMFEKARLIGKGTTEPHPFLYKVFARSIPANAVEFYERYLIERKFYLTGLSNEIKKGNRVDVPF
IRRDQNKWKTPAMKTLGRIYSEDLPVELPRQMFDNEIKSHLKSLPQMEGIDFNNANVTYLIAEYMKRVLDDDFQTFYQ
WNRNYRYMDMLKGEYDRKGSLQHCFTSVEEREGLWKERASRTERYRKQASNKIRSNRQMRNASSEEIETILDKRLSNS
RNEYQKSEKVIRRYRVQDALLFLLAKKTLTELADFDGERFKLKEIMPDAEKGILSEIMPMSFTFEKGGKKYTITSEGMKLK
NYGDFFVLASDKRIGNLLELVGSDIVSKEDIMEEFNKYDQCRPEISSIVFNLEKWAFDTYPELSARVDREEKVDFKSILKILL
NNKNINKEQSDILRKIRNAFDHNNYPDKGVVEIKALPEIAMSIKKAFGEYAIMK SEQ ID NO: 160

16    WP_014084666  Flavobacterium branchiophilum

MENLNKILDKENEICISKIFNTKGIAAPITEKALDNIKSKQKNDLNKEARLHYFSIGHSFKQIDTKKVFDYVLIEELK
DEKPLKFITLQKDFFTKEFSIKLQKLINSIRNINNHYVHNFNDINLNKIDSNVFHFLKESFELAIIEKYYKVNKKYPLDNEIVLF
LKELFIKDENTALLNYFTNLSKDEAIEYILTFTITENKIWNINNEHNILNIEKGKYLTFEAMLFLITIFLYKNEANHLLPKLYDFK
NNKSKQELFTFFSKKFTSQDIDAEEGHLIKFRDMIQYLNHYPTAWNNDLKLESENKNKIMTTKLIDSIIEFELNSNYPSFAT
DIQFKKEAKAFLFASNKKRNQTSFSNKSYNEEIRHNPHIKQYRDEIASALTPISFNVKEDKFKIFVKKHVLEEYFPNSIGYEK
FLEYNDFTEKEKEDFGLKLYSNPKTNKLIERIDNHKLVKSHGRNQDRFMDFSMRFLAENNYFGKDAFFKCYKFYDTQEQ
DEFLQSNENNDDVKFHKGKVTTYIKYEEHLKNYSYWDCPFVEENNSMSVKISIGSEEKILKIQRNLMIYFLENALYNENVE
NQGYKLVNNYYRELKKDVEESIASLDLIKSNPDFKSKYKKILPKRLLHNYAPAKQDKAPENAFETLLKKADFREEQYKKLLK
KAEHEKNKEDFVKRNKGKQFKLHFIRKACQMMYFKEKYNTLKEGNAAFEKKDPVIEKRKNKEHEFGHHKNLNITREEFN
DYCKWMFAFNGNDSYKKYLRDLFSEKHFFDNQEYKNLFESSVNLEAFYAKTKELFKKWIETNKPTNNENRYTLENYKNLI
LQKQVFINVYHFSKYLIDKNLLNSENNVIQYKSLENVEYLISDFYFQSKLSIDQYKTCGKLFNKLKSNKLEDCLLYEIAYNYID
KKNVHKIDIQKILTSKIILTINDANTPYKISVPFNKLERYTEMIAIKNQNNLKARFLIDLPLYLSKNKIKKGKDSAGYEIIIKNDL
EIEDINTINNKIINDSVKFTEVLMELEKYFILKDKCILSKNYIDNSEIPSLKQFSKVVWIKENENEIINYRNIACHFHLPLLETFDN
LLLNVEQKFIKEELQNVSTINDLSKPQEYLILLFIKFKHNNFYLNLFNKNESKTIKNDKEVKKNRVLQKFINQVILKKK
SEQ ID NO: 161

17    WP_058700060  Myroides odoratimimus

MKDILTTDTTEKQNRFYSHKIADKYFFGGYFNLASNNIYEVFEEVNKRNTFGKLAKRDNGNLKNYIIHVFKDELS
ISDFEKRVAIFASYFPILETVDKKSIKERNRTIDLTLSQRIRQFREMLISLVTAVDQLRNFYTHYHHSDIVIENKVLDFLNSSFV
STALHVKDKYLKTDKTKEFLKETIAAELDILIEAYKKKQIEKKNTRFKANKREDILNAIYNEAFWSFINDKDKDKDKETVVAK
GADAYFEKNHHKSNDPDFALNISEKGIVYLLSFFLTNKEMDSLKANLTGFKGKVDRESGNSIKYMATQRIYSFHTYRGLK
QKIRTSEEGVKETLLMQMIDELSKVPNVVYQHLSTTQQNSFIEDWNEYYKDYEDDVETDDLSRVTHPVIRKRYEDRFNY
FAIRFLDEFFDFPTLRFQVHLGDYVHDRRTKQLGKVESDRIIKEKVTVFARLKDINSAKASYFHSLEEQDKEELDNKWTLFP
NPSYDFPKEHTLQHQGEQKNAGKIGIYVKLRDTQYKEKAALEEARKSLNPKERSATKASKYDIITQIIEANDNVKSEKPLVF
TGQPIAYLSMNDIHSMLFSLLTDNAELKKTPEEVEAKLIDQIGKQINEILSKDTDTKILKKYKDNDLKETDTDKITRDLARDK
EEIEKLILEQKQRADDYNYTSSTKFNIDKSRKRKHLLFNAEKGKIGVWLANDIKRFMFKESKSKWKGYQHIELQKLFAYFD
TSKSDLELILSNMVMVKDYPIELIDLVKKSRTLVDFLNKYLEARLEYIENVITRVKNSIGTPQFKTVRKECFTFLKKSNYTVVS
LDKQVERILSMPLFIERGFMDDKPTMLEGKSYKQHKEKFADWFVHYKENSNYQNFYDTEVYEITTEDKREKAKVTKKIK
QQQKNDVFTLMMVNYMLEEVLKLSSNDRLSLNELYQTKEERIVNKQVAKDTQERNKNYIWNKVVDLQLCDGLVHIDN
VKLKDIGNFRKYENDSRVKEFLTYQSDIVWSAYLSNEVDSNKLYVIERQLDNYESIRSKELLKEVQEIECSVYNQVANKESL
KQSGNENFKQYVLQGLLPIGMDVREMLILSTDVKFKKEEIIQLGQAGEVEQDLYSLIYIRNKFAHNQLPIKEFFDFCENNY
RSISDNEYYAEYYMEIFRSIKEKYAN SEQ ID NO: 162

FIG 1 *(Continued)*

18 WP_065213424 Flavobacterium columnare
MSSKNESYNKQKTFNHYKQEDKYFFGGFLNNADDNLRQVGKEFKTRINFNHNNNELASVFKDYFNKEKSVA
KREHALNLLSNYFPVLERIQKHTNHNFEQTREIFELLLDTIKKLRDYYTHHYHKPITINPKIYDFLDDTLLDVLITIKKKKVKN
DTSRELLKEKLRPELTQLKNQKREELIKKGKKLLEENLENAVFNHCLIPFLEENKTDDKQNKTVSLRKYRKSKPNEETSITLT
QSGLVFLMSFFLHRKEFQVFTSGLERFKAKVNTIKEEEISLNKNNIVYMITHWSYSYYNFKGLKHRIKTDQGVSTLEQNNT
THSLTNTNTKEALLTQIVDYLSKVPNEIYETLSEKQQKEFEEDINEYMRENPENEDSTFSSIVSHKVIRKRYENKFNYFAMR
FLDEYAELPTLRFMVNFGDYIKDRQKKILESIQFDSERIIKKEIHLFEKLSLVTEYKKNVYLKETSNIDLSRFPLFPNPSYVMA
NNNIPFYIDSRSNNLDEYLNQKKKAQSQNKKRNLTFEKYNKEQSKDAIIAMLQKEIGVKDLQQRSTIGLLSCNELPSMLY
EVIVKDIKGAELENKIAQKIREQYQSIRDFTLDSPQKDNIPTTLIKTINTDSSVTFENQPIDIPRLKNALQKELTLTQEKLLNV
KEHEIEVDNYNRNKNTYKFKNQPKNKVDDKKLQRKYVFYRNEIRQEANWLASDLIHFMKNKSLWKGYMHNELQSFLA
FFEDKKNDCIALLETVFNLKEDCILTKGLKNLFLKHGNFIDFYKEYLKLKEDFLSTESTFLENGFIGLPPKILKKELSKRLKYIFIV
FQKRQFIIKELEEKKNNLYADAINLSRGIFDEKPTMIPFKKPNPDEFASWFVASYQYNNYQSFYELTPDIVERDKKKKYKNL
RAINKVKIQDYYLKLMVDTLYQDLFNQPLDKSLSDFYVSKAEREKIKADAKAYQKLNDSSLWNKVIHLSLQNNRITANPK
LKDIGKYKRALQDEKIATLLTYDARTWTYALQKPEKENENDYKELHYTALNMELQEYEKVRSKELLKQVQELEKKILDKFY
DFSNNASHPEDLEIEDKKGKRHPNFKLYITKALLKNESEIINLENIDIEILLKYYDYNTEELKEKIKNMDEDEKAKIINTKENY
NKITNVLIKKALVLIIIRNKMAHNQYPPKFIYDLANRFVPKKEEEYFATYFNRVFETITKELWENKEKKDKTQV
SEQ ID NO: 163

19 WP_053444417 Porphyromonas gingivalis
MTEQNEKPYNGTYYTLEDKHFWAAFLNLARHNAYITLAHIDRQLAYSKADITNDEDILFFKGQWKNLDNDLE
RKARLRSLILKHFSFLEGAAYGKKLFESQSSGNKSSKKKELSKKEKEELQANALSLDNLKSILFDFLQKLKDFRNYYSHYRHP
ESSELPLFDGNMLQRLYNVFDVSVQRVKRDHEHNDKVDPHRHFNHLVRKGKKDKYGNNDNPFFKHHFVDREGTVTE
AGLLFFVSLFLEKRDAIWMQKKIRGFKGGTEAYQQMTNEVFCRSRISLPKLKLESLRTDDWMLLDMLNELVRCPKSLYD
RLREEDRARFRVPVDILSDEDDTDGTEEDPFKNTLVRHQDRFPYFALRYFDLKKVFTSLRFHIDLGTYHFAIYKKNIGEQPE
DRHLTRNLYGFGRIQDFAEEHRPEEWKRLVRDLDYFETGDKPYITQTTPHYHIEKGKIGLRFVPEGQHLWPSPEVGATRT
GRSKYAQDKRLTAEAFLSVHELMPMMFYYFLLREKYSEEVSAEKVQGRIKRVIEDVYAVYDAFARDEINTRDELDACLAD
KGIRRGHLPRQMIAILSQEHKDMEEKVRKKLQEMIADTDHRLDMLDRQTDRKIRIGRKNAGLPKSGVVADWLVRDM
MRFQPVAKDTSGKPLNNSKANSTEYRMLQRALALFGGEKERLTPYFRQMNLTGGNNPHPFLHETRWESHTNILSFYRS
YLEARKAFLQSIGRSDRVENHRFLLLKEPKTDRQTLVAGWKGEFHLPRGIFTEAVRDCLIEMGYDEVGSYKEVGFMAKA
VPLYFERASKDRVQPFYDYPFNVGNSLKPKKGRFLSKEKRAEEWESGKERFRLAKLKKEILEAKEHPYHDFKSWQKFERE
LRLVKNQDIITWMMCRDLMEENKVEGLDTGTLYLKDIRTDVQEQGSLNVLNRVKPMRLPVVVYRADSRGHVHKEQA
PLATVYIEERDTKLLKQGNFKSFVKDRRLNGLFSFVDTGALAMEQYPISKLRVEYELAKYQTARVCAFEQTLELEESLLTRY
PHLPDKNFRKMLESWSDPLLDKWPDLHGNVRLLIAVRNAFSHNQYPMYDETLFSSIRKYDPSSPDAIEERMGLNIAHRL
SEEVKQAKEMVERIIQA SEQ ID NO: 164

20 WP_039428968 Porphyromonas sp. COT-052 OH4946
MTEQSERPYNGTYYTLEDKHFWAAFLNLARHNAYITLTHIDRQLAYSKADITNDQDVLSFKALWKNFDNDLE
RKSRLRSLILKHFSFLEGAAYGKKLFESKSSGNKSSKNKELTKKEKEELQANALSLDNLKSILFDFLQKLKDFRNYYSHYRHS
ESSELPLFDGNMLQRLYNVFDVSVQRVKRDHEHNDKVDPHRHFNHLVRKGKKDRYGHNDNPSFKHHFVDSEGMVTE
AGLLFFVSLFLEKRDAIWMQKKIRGFKGGTETYQQMTNEVFCRSRISLPKLKLESLRTDDWMLLDMLNELVRCPKPLYD
RLREDDRACFRVPVDILPDEDDTDGGGEDPFKNTLVRHQDRFPYFALRYFDLKKVFTSLRFHIDLGTYHFAIYKKMIGEQ

FIG 1 *(Continued)*

PEDRHLTRNLYGFGRIQDFAEEHRPEEWKRLVRDLDYFETGDKPYISQTTPHYHIEKGKIGLRFVPEGQHLWPSPEVGTT
RTGRSKYAQDKRLTAEAFLSVHELMPMMFYYFLLREKYSEEVSAEKVQGRIKRVIEDVYAIYDAFARDEINTLKELDACLA
DKGIRRGHLPKQMIGILSQERKDMEEKVRKKLQEMIADTDHRLDMLDRQTDRKIRIGRKNAGLPKSGVIADWLVRDM
MRFQPVAKDTSGKPLNNSKANSTEYRMLQRALALFGGEKERLTPYFRQMNLTGGNNPHPFLHETRWESHTNILSFYRS
YLRARKAFLERIGRSDRVENCPFLLLKEPKTDRQTLVAGWKGEFHLPRGIFTEAVRDCLIEMGYDEVGSYREVGFMAKA
VPLYFERACEDRVQPFYDSPFNVGNSLKPKKGRFLSKEDRAEEWERGKERFRDLEAWSHSAARRIKDAFAGIEYASPGN
KKKIEQLLRDLSLWEAFESKLKVRADKINLAKLKKEILEAQEHPYHDFKSWQKFERELRLVKNQDIITWMMCRDLMEEN
KVEGLDTGTLYLKDIRPNVQEQGSLNVLNRVKPMRLPVVVYRADSRGHVHKEEAPLATVYIEERDTKLLKQGNFKSFVK
DRRLNGLFSFVDTGGLAMEQYPISKLRVEYELAKYQTARVCVFELTLRLEESLLSRYPHLPDESFREMLESWSDPLLAKWP
ELHGKVRLLIAVRNAFSHNQYPMYDEAVFSSIRKYDPSSPDAIEERMGLNIAHRLSEEVKQAKETVERIIQA SEQ ID NO: 165

21    WP_050955369  Prevotella intermedia
MEDDKKTKESTNMLDNKHFWAAFLNLARHNVYITVNHINKVLELKNKKDQDIIIDNDQDILAIKTHWEKVNG
DLNKTERLRELMTKHFPFLETAIYTKNKEDKEEVKQEKQAKAQSFDSLKHCLFLFLEKLQEARNYYSHYKYSESTKEPMLE
KELLKKMYNIFDDNIQLVIKDYQHNKDINPDEDFKHLDRTEEEFNYYFTTNKKGNITASGLLFFVSLFLEKKDAIWMQQK
LRGFKDNRESKKKMTHEVFCRSRMLLPKLRLESTQTQDWILLDMLNELIRCPKSLYERLQGEYRKKFNVPFDSADEDYD
AEQEPFKNTLVRHQDRFPYFALRYFDYNEIFTNLRFQIDLGTYHFSIYKKLIGGQKEDRHLTHKLYGFERIQEFAKQNRTDE
WKAIVKDFDTYETSEEPYISETAPHYHLENQKIGIRFRNDNDEIWPSLKTNGENNEKRKYKLDKQYQAEAFLSVHELLPM
MFYYLLLKKEEPNNDKKNASIVEGFIKREIRDIYKLYDAFANGEINNIDDLEKYCEDKGIPKRHLPKQMVAILYDEHKDMA
EEAKRKQKEMVKDTKKLLATLEKQTQGEIEDGGRNIRLLKSGEIARWLVNDMMRFQPVQKDNEGNPLNNSKANSTEY
QMLQRSLALYNKEEKPTRYFRQVNLINSSNPHPFLKWTKWEECNNILSFYRSYLTKKIEFLNKLKPEDWEKNQYFLKLKE
PKTNRETLVQGWKNGFNLPRGIFTEPIREWFKRHQNDSEEYEKVETLDRVGLVTKVIPLFFKKEDSKDKEEYLKKDAQKE
INNCVQPFYGFPYNVGNIHKPDEKDFLPSEERKKLWGDKKYKFKGYKAKVKSKKLTDKEKEEYRSYLEFQSWNKFERELR
LVRNQDIVTWLLCTELIDKLKVEGLNVEELKKLRLKDIDTDTAKQEKNNILNRVMPMQLPVTVYEIDDSHNIVKDRPLHT
VYIEETKTKLLKQGNFKALVKDRRLNGLFSFVDTSSETELKSNPISKSLVEYELGEYQNARIETIKDMLLLEETLIEKYKTLPTD
NFSDMLNGWLEGKDEADKARFQNDVKLLVAVRNAFSHNQYPMRNRIAFANINPFSLSSADTSEEKKLDIANQLKDKT
HKIIKRIIEIEKPIETKE SEQ ID NO: 166

FIG 2

| ortholog | source | Efficacy in mammalian cells |
|---|---|---|
| 1 | Bergeyella zoohelcum | Medium |
| 2 | Prevotella intermedia | Low/No |
| 3 | Prevotella buccae | Medium |
| 4 | Porphyromonas gingivalis | Low/No |
| 5 | Bacteroides pyogenes | High |
| 6 | Alistipes sp. ZOR0009 | Medium |
| 7 | Prevotella sp. MA2016 | Medium |
| 8 | Riemerella anatipestifer | High |
| 9 | Prevotella aurantiaca | Medium (with csx28) |
| 10 | Prevotella saccharolytica | No |
| 11 | Myroides odoratimimus CCUG 10230 | Low/No |
| 12 | Prevotella intermedia | Low/No |
| 13 | Capnocytophaga canimorsus | Medium |
| 14 | Porphyromonas gulae | Gold |
| 15 | Prevotella sp. P5-125 | Gold |
| 16 | Flavobacterium branchiophilum | Low/No |
| 17 | Myroides odoratimimus | Low/No |
| 18 | Flavobacterium columnare | Low/No |
| 19 | Porphyromonas gingivalis | Gold |
| 20 | Porphyromonas sp. COT-052 OH4946 | Gold |
| 21 | Prevotella intermedia | Medium |

Key:

Low/No    All guide <50% knockdown of luciferase

Medium    Majority of guides ~50% knockdown of luciferase

High      Majority of guides >50% knockdown of luciferase

Gold      Majority of guides >80% knockdown of luciferase

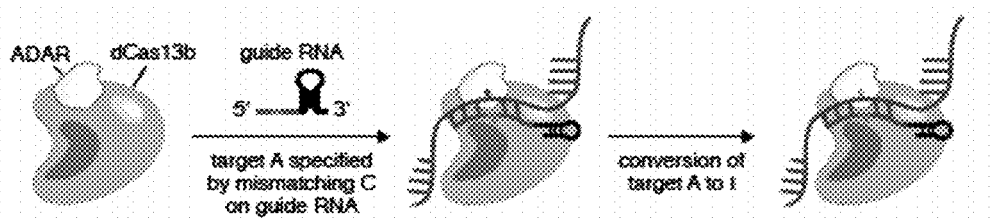
FIG. 6A
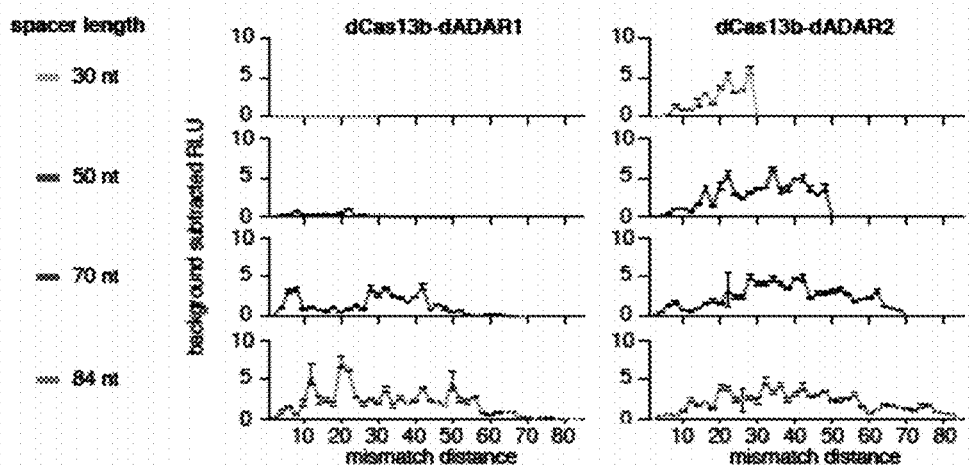
FIG. 6B
FIG. 6C
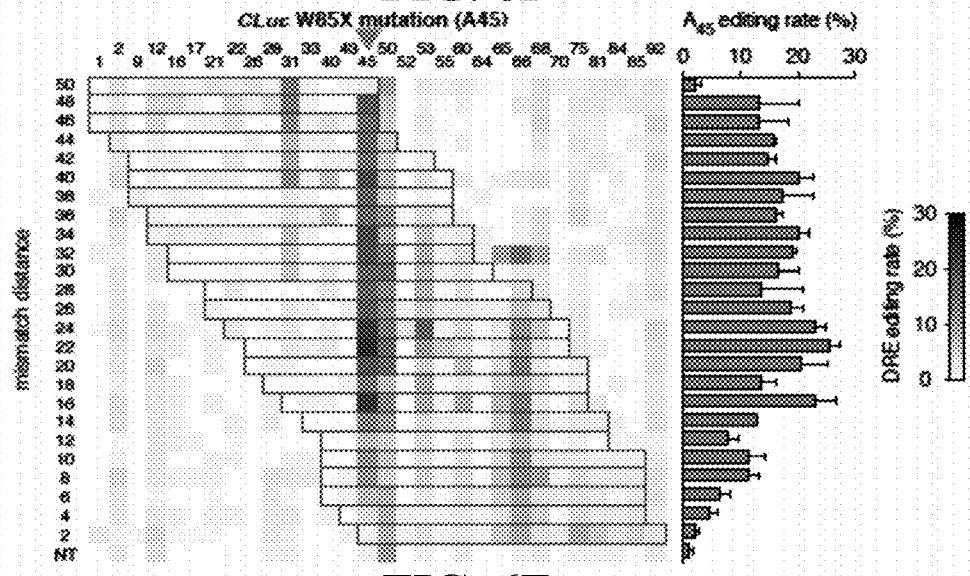
FIG. 6D
FIG. 6E

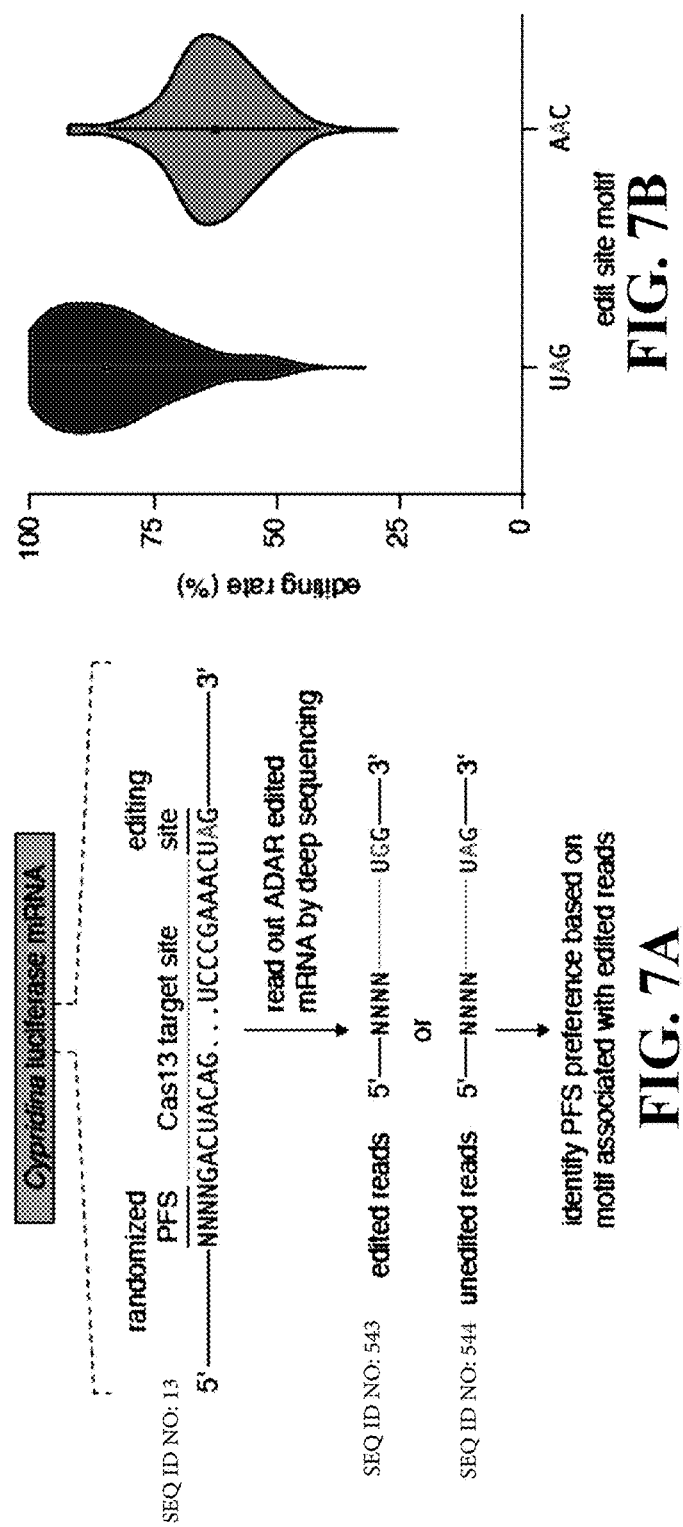
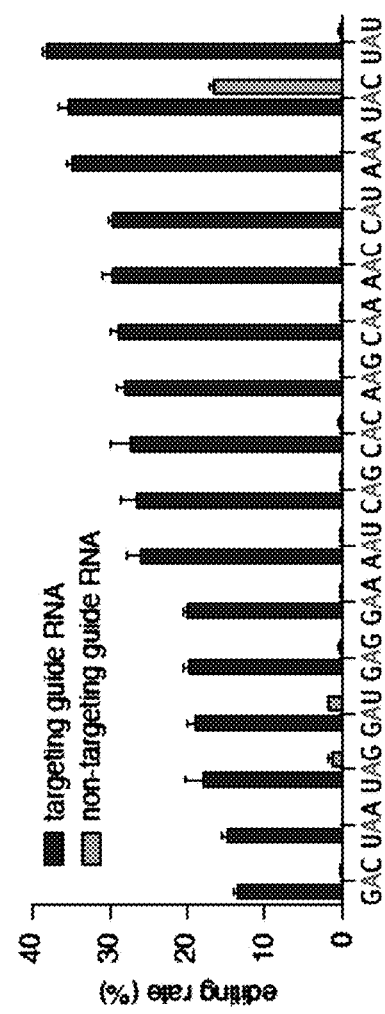
FIG. 7A
FIG. 7B
FIG. 7C
FIG. 7D

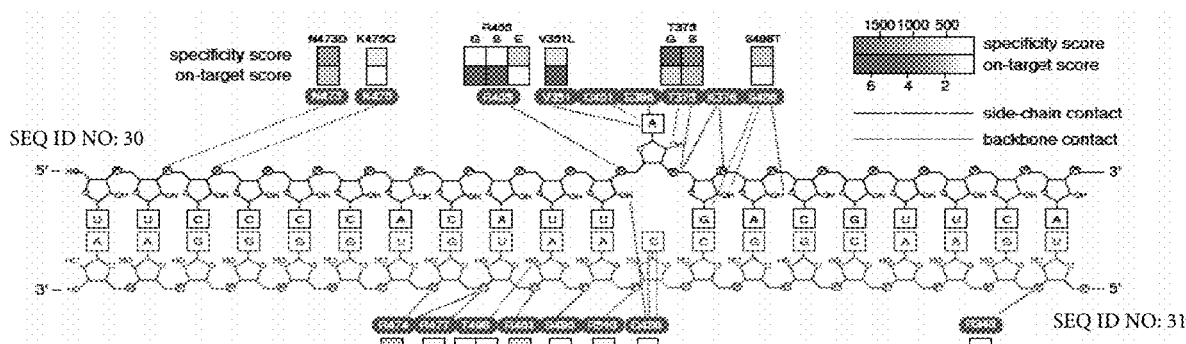
SEQ ID NO: 30
SEQ ID NO: 31
FIG. 10A
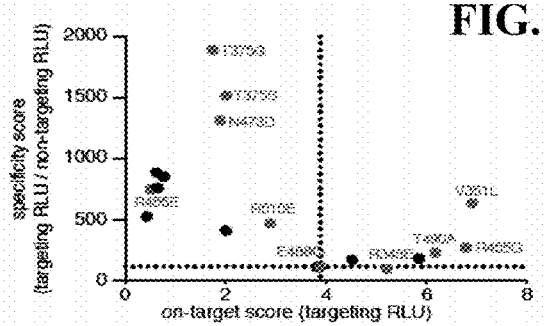
FIG. 10B
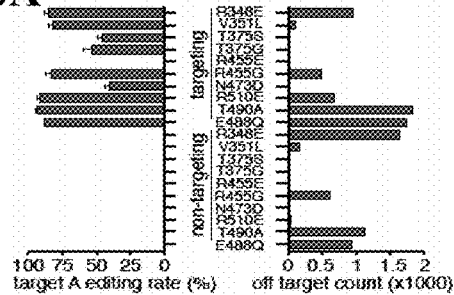
FIG. 10C
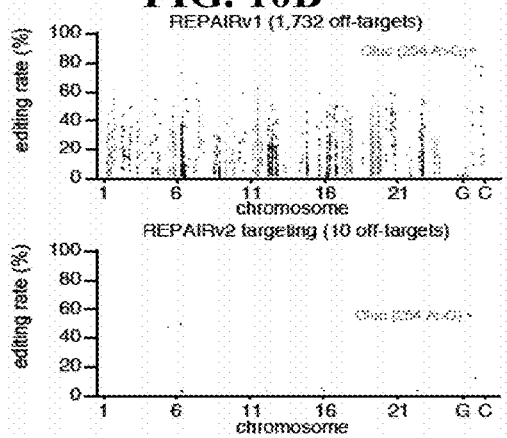
FIG. 10D
FIG. 10E    SEQ ID NOS: 32-52
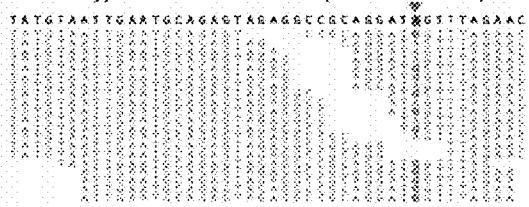
SEQ ID NOS: 53-73
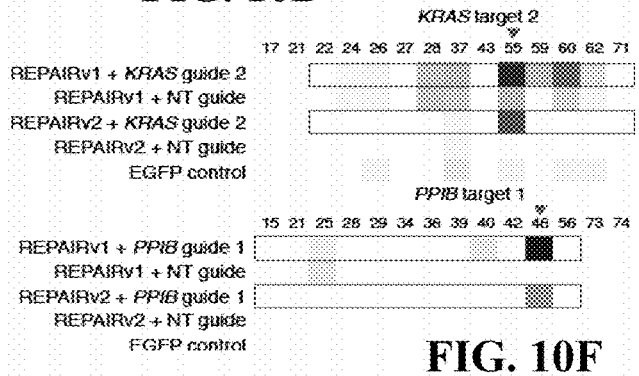
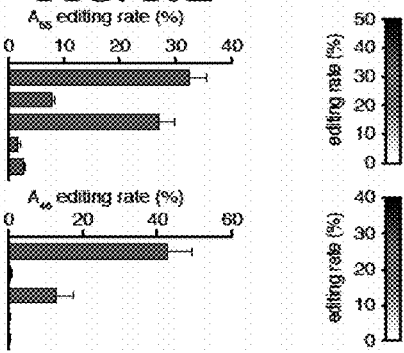
FIG. 10F

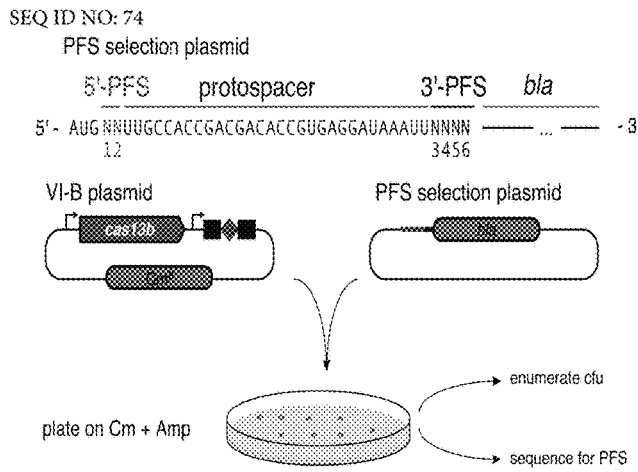
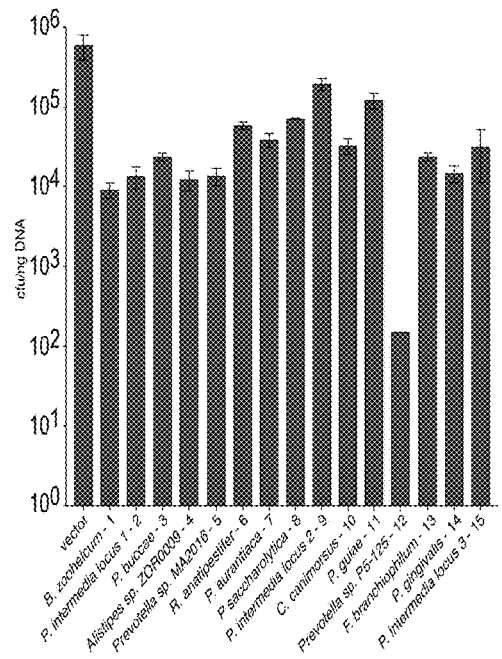
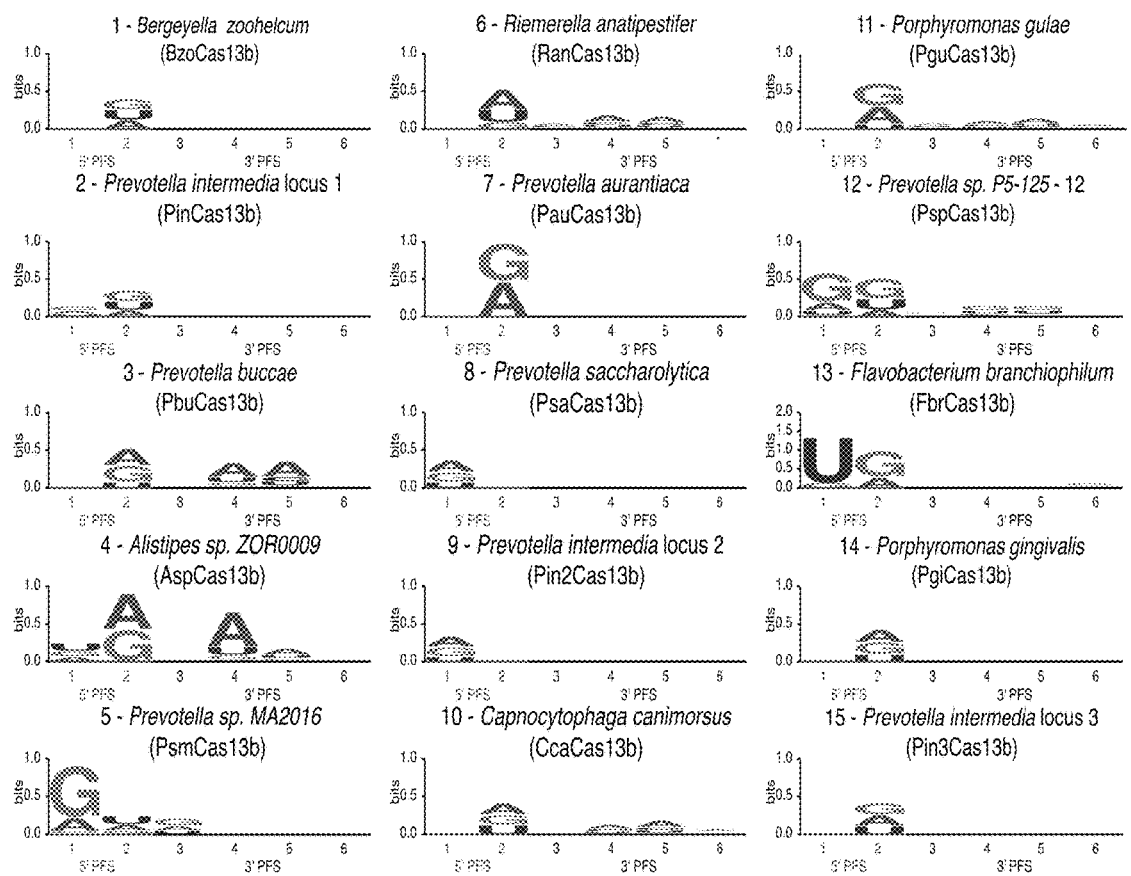
FIG. 11A
FIG. 11B
FIG. 11C

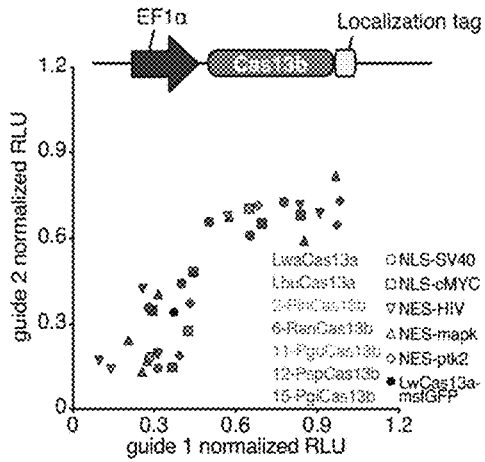
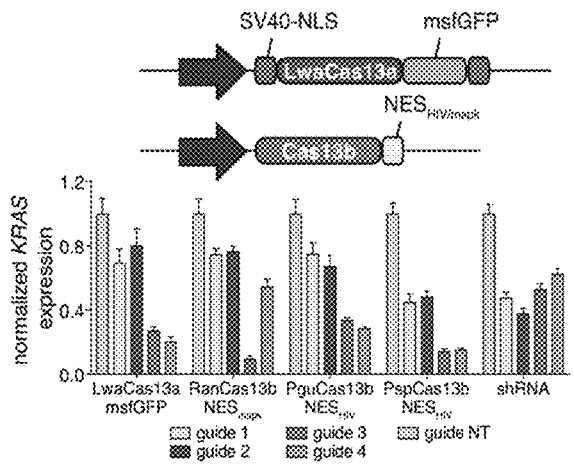
SEQ ID NOS: 75-87
FIG. 12A
SEQ ID NO: 90
FIG. 12B
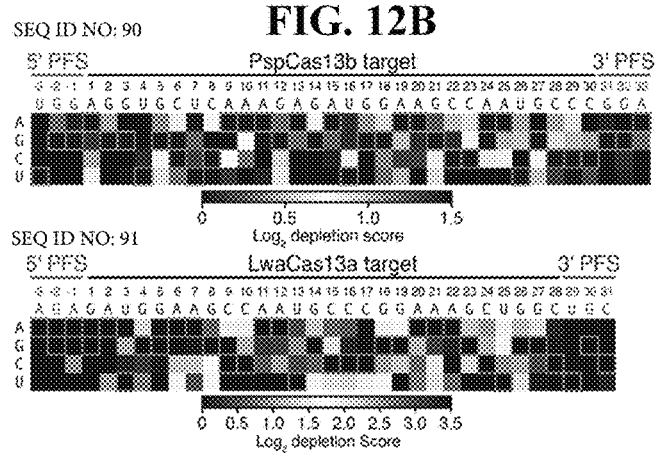
FIG. 12C
SEQ ID NO: 91
FIG. 12D
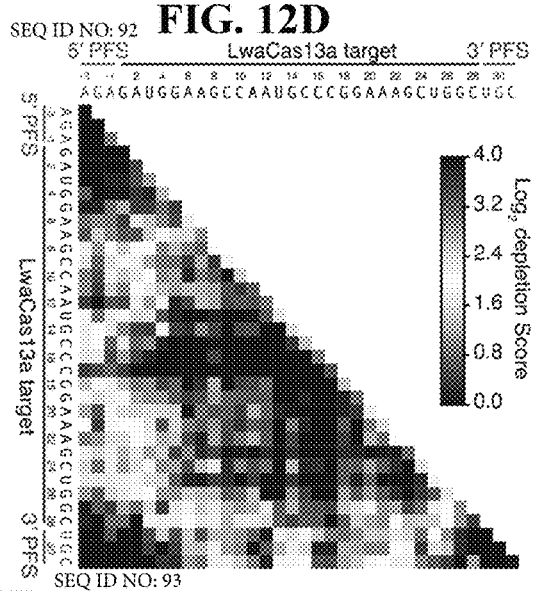
SEQ ID NO: 88
SEQ ID NO: 92
SEQ ID NO: 89
SEQ ID NO: 93
FIG. 12E

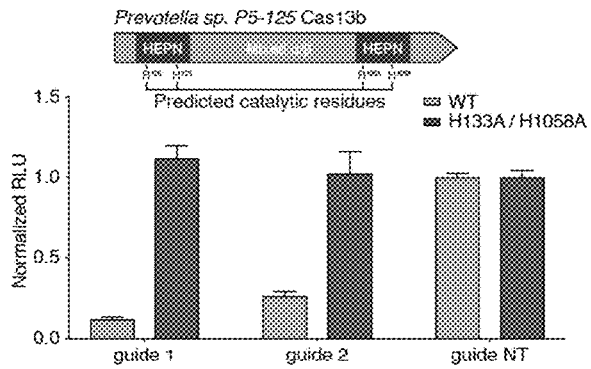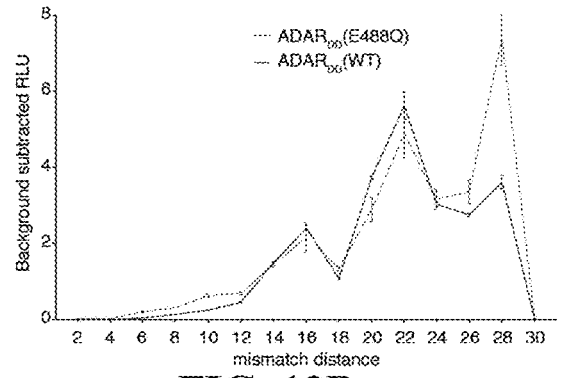
FIG. 13A
FIG. 13B
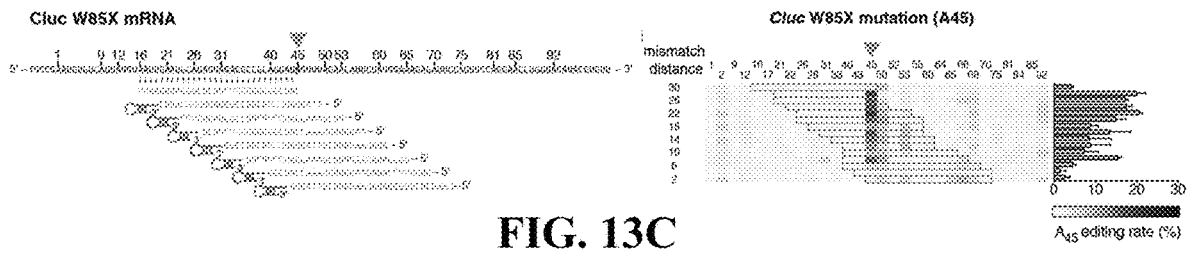
FIG. 13C
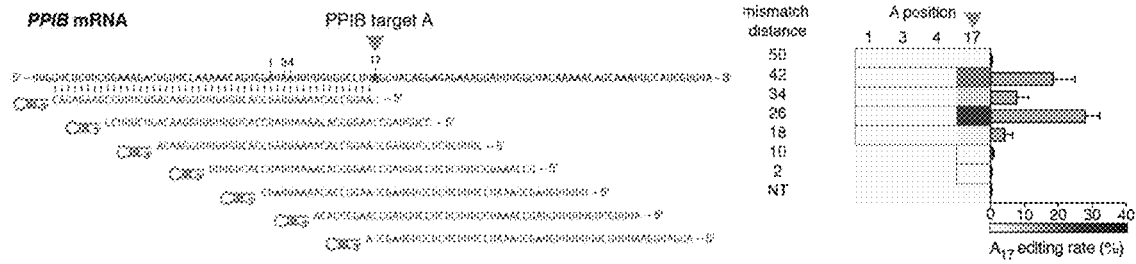
FIG. 13D
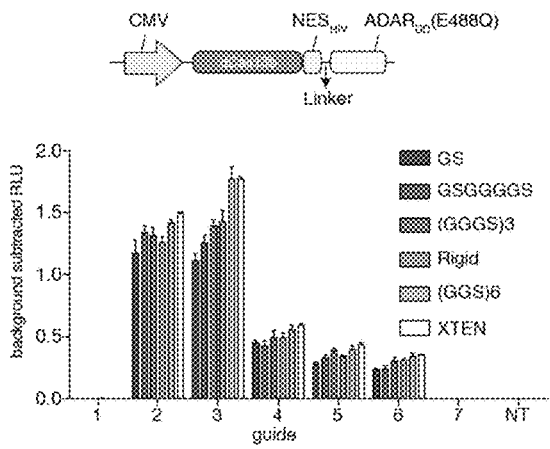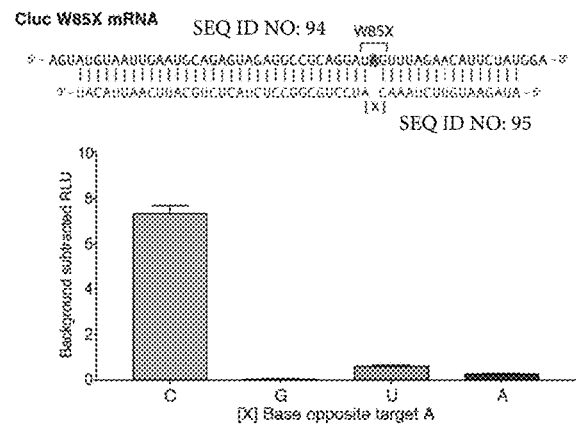
FIG. 13E
FIG. 13F

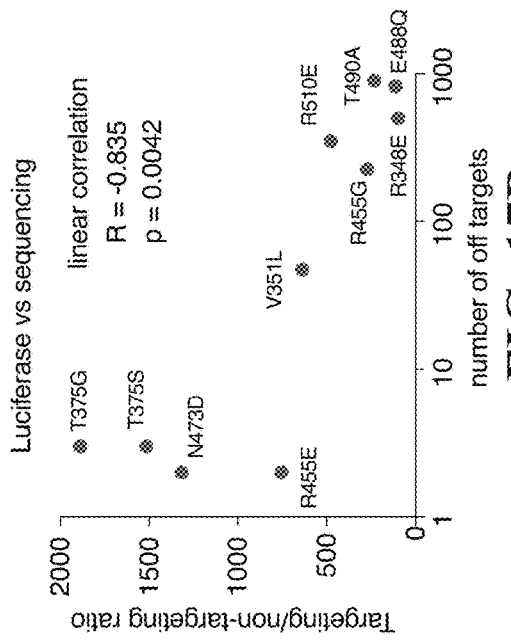
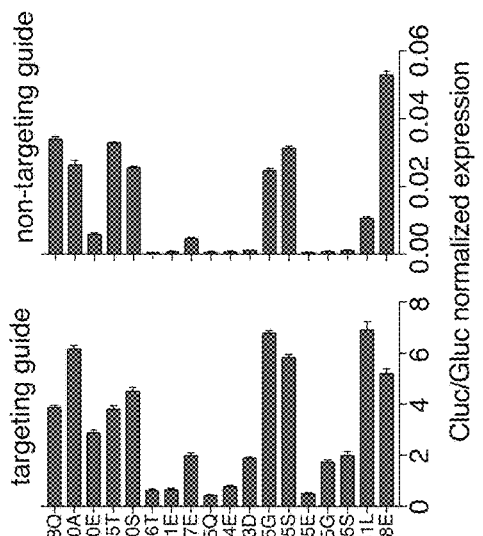
FIG. 17A
FIG. 17B
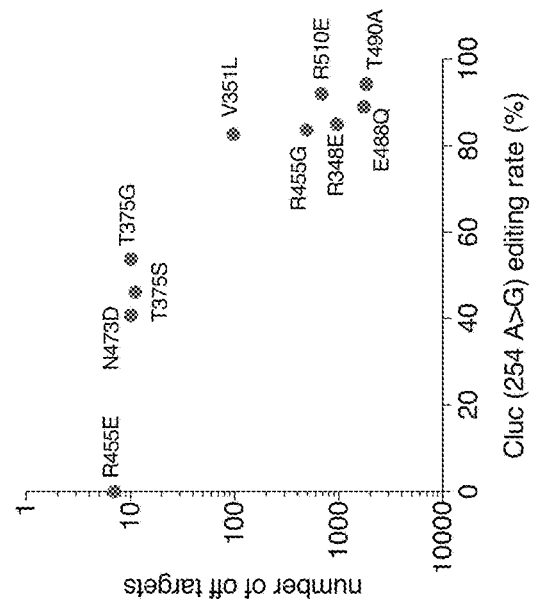
FIG. 17C

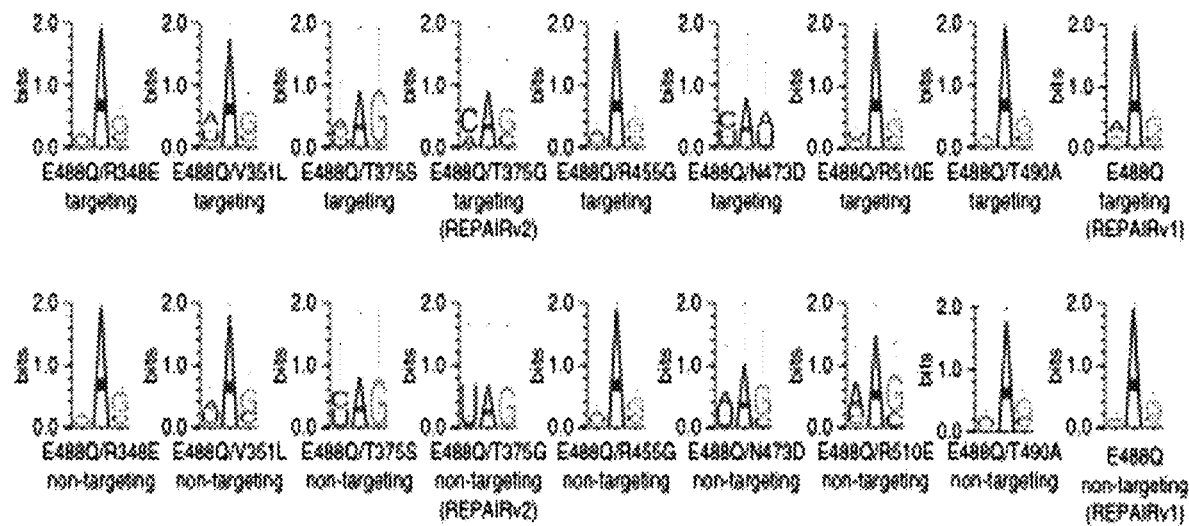
FIG. 19A
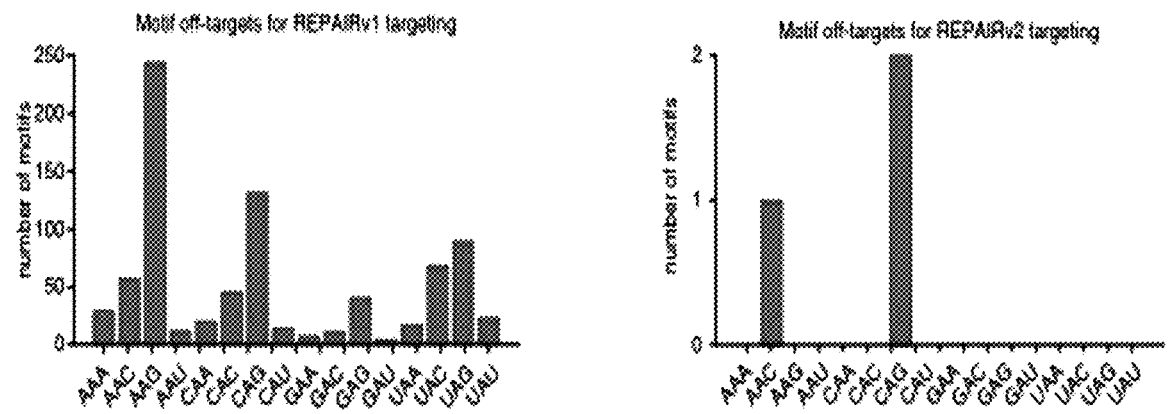
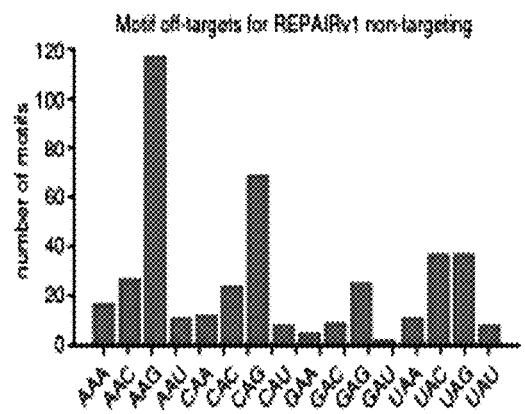
FIG. 19B
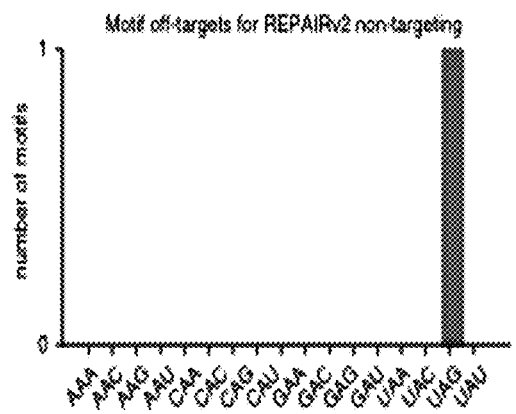
FIG. 19C

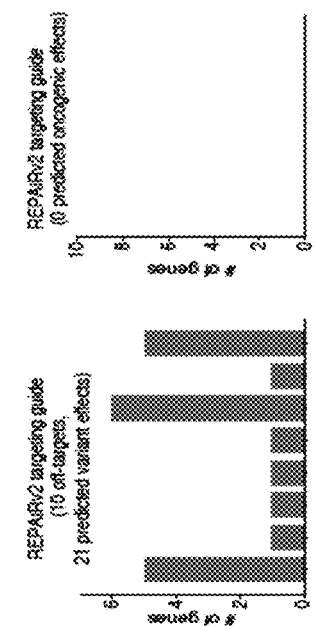
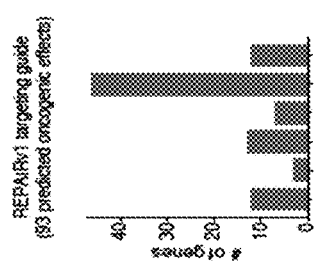
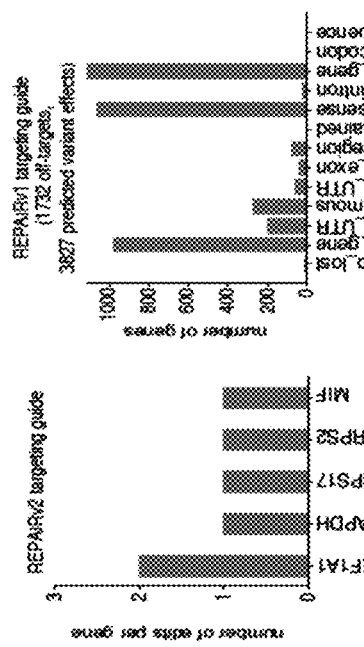
FIG. 20A
FIG. 20B
FIG. 20C
FIG. 20D
FIG. 20E
FIG. 20F

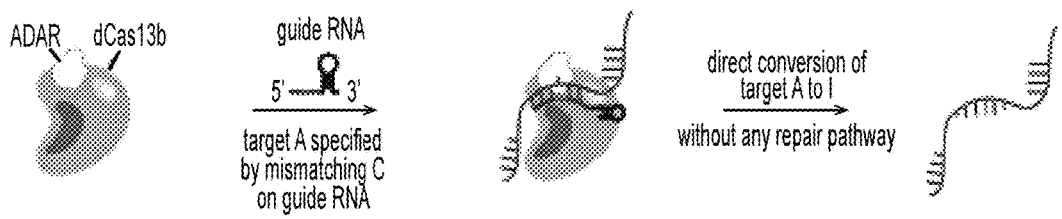
FIG. 22A FIG. 22B
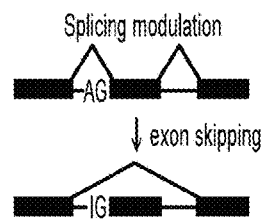
FIG. 22C
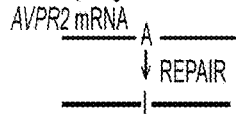 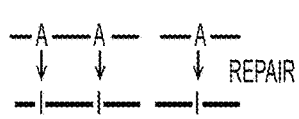
FIG. 22D FIG. 22E FIG. 22F FIG. 22G

TYPE VI CRISPR ORTHOLOGS AND SYSTEMS

RELATED APPLICATIONS AND INCORPORATION BY REFERENCE

This application is a U.S. national stage application based on International Application No. PCT/US2018/027125 filed Apr. 11, 2018, which claims priority to U.S. Provisional Application No. 62/484,791 filed Apr. 12, 2017, U.S. Provisional Application No. 62/561,662 filed Sep. 21, 2017, and U.S. Provisional Application No. 62/568,129 filed Oct. 4, 2017, each of which is incorporated herein by reference in its entirety.

STATEMENT AS TO FEDERALLY SPONSORED RESEARCH

This invention was made with government support under grant numbers MH100706 and MH110049 awarded by the National Institutes of Health. The government has certain rights in the invention.

SEQUENCE LISTING

The substitute electronic sequence listing ("BROD-4770US_Substitute_ST25.txt;" Size is 1,178,276 bytes and it was created on Dec. 27, 2022) is herein incorporated by reference in its entirety and replaces any all previously submitted Sequence Listings.

Reference is made to PCT application including as it designates the US, inter alia, application No. PCT/US2016/058302, filed Oct. 21, 2016. Reference is made to U.S. provisional patent application 62/245,270 filed on Oct. 22, 2015, U.S. provisional patent application 62/296,548 filed on Feb. 17, 2016, and U.S. provisional patent applications 62/376,367 and 62/376,382, filed on Aug. 17, 2016. Reference is further made to U.S. 62/471,792, filed Mar. 15, 2017. Reference is further made to U.S. provisional patent application 62/471,170, filed Mar. 17, 2017. Reference is further made to U.S. provisional patent application 62/484,791, filed Apr. 12, 2017. Reference is further made to U.S. provisional patent application 62/561,662, filed Sep. 21, 2017. Mention is made of: Smargon et al. (2017), "Cas13b Is a Type VI-B CRISPR-Associated RNA-Guided RNase Differentially Regulated by Accessory Proteins Csx27 and Csx28," Molecular Cell 65, 618-630 (Feb. 16, 2017) doi: 10.1016/j.molcel.2016.12.023. Epub Jan. 5, 2017 and Smargon et al. (2017), "Cas13b Is a Type VI-B CRISPR-Associated RNA-Guided RNase Differentially Regulated by Accessory Proteins Csx27 and Csx28," bioRxiv 092577; doi: doi.org/10.1101/092577. Posted Dec. 9, 2017. Each of the foregoing applications and literature citations are hereby incorporated herein by reference.

All documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FIELD OF THE INVENTION

The present invention generally relates to systems, methods and compositions used for the control of gene expression involving sequence targeting, such as perturbation of gene transcripts or nucleic acid editing, that may use vector systems related to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome and transcriptome engineering technologies that employ novel strategies and molecular mechanisms and are affordable, easy to set up, scalable, and amenable to targeting multiple positions within the eukaryotic genome and transcriptome. This would provide a major resource for new applications in genome engineering and biotechnology.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of about 395 profiles for 93 Cas proteins. Classification includes signature gene profiles plus signatures of locus architecture. A new classification of CRISPR-Cas systems is proposed in which these systems are broadly divided into two classes, Class 1 with multisubunit effector complexes and Class 2 with single-subunit effector modules exemplified by the Cas9 protein. Novel effector proteins associated with Class 2 CRISPR-Cas systems may be developed as powerful genome engineering tools and the prediction of putative novel effector proteins and their engineering and optimization is important.

The CRISPR-Cas adaptive immune system defends microbes against foreign genetic elements via DNA or RNA-DNA interference. Class 2 type VI single-component CRISPR-Cas effectors target RNA. One such is Cas13a (also known as C2c2; see Shmakov et al. (2015) "Discovery and Functional Characterization of Diverse Class 2 CRISPR-Cas Systems"; Molecular Cell 60:1-13; doi: dx.doi.org/10.1016/j.molcel.2015.10.008), which was characterized as an RNA-guided Rnase (Abudayyeh et al. (2016), Science, [Epub ahead of print], June 2; "C2c2 is a single-component programmable RNA-guided RNA-targeting CRISPR effector"; doi: 10.1126/science.aaf5573). Under current classification, Cas13a is a Class 2 type VI-A CRISPR-Cas system. An alternative is provided by Cas13b, a Class 2 Type VI-B effector protein. Class 2 Type VI-B effector proteins include two subgroups, Type VI-B1 and Type VI-B2, which are also referred to as Group 29 proteins and Group 30 proteins, and include members which are RNA-programmable nucleases, RNA-interfering and may be involved in bacterial adaptive immunity against RNA phages. (See Smargon A et al. "Cas13b is a Type VI-B CRISPR-associated RNA-Guided RNAse differentially regulated by accessory proteins Csx27 and Csx28", Molecular Cell, online Jan. 5, 2017. DOI: 10.1016/j.molcel.2016.12.023).

Group 29 and group 30 systems comprise a large single effector (approximately 1100 amino acids in length), termed Cas13b, and one or none of two small putative accessory proteins (approximately 200 amino acids in length, and termed Csx27 and Csx28) nearby a CRISPR array. Based on the nearby small protein, the system is classified as Type VI-B1 (Csx27) or Type VI-B2 (Csx28). No additional proteins out to 25 kilobase pairs upstream or downstream from the array are conserved across species with each locus. With minor exceptions, the CRISPR array comprises direct repeat sequences 36 nucleotides in length and spacer sequences 30 nucleotides in length. The direct repeat is generally well conserved, especially at the ends, with a GTTG/GUUG at the 5' end reverse complementary to a CAAC at the 3' end. This conservation suggests strong base pairing for an RNA loop structure that potentially interacts with the protein(s) in the locus. A motif search complementary to the direct repeats revealed no candidate tracrRNAs nearby the arrays, indicative of a single crRNA like that found in the Cpf1 locus.

Citation or identification of any document in this application is not an admission that such document is available as prior art to the present invention.

SUMMARY OF THE INVENTION

There exists a pressing need for alternative and robust systems and techniques for targeting nucleic acids or polynucleotides (e.g. DNA or RNA or any hybrid or derivative thereof) with a wide array of applications, in particular in eukaryotic systems, more in particular in mammalian systems. This invention addresses this need and provides related advantages. Adding the novel RNA-targeting systems of the present application to the repertoire of genomic, transcriptomic, and epigenomic targeting technologies may transform the study and perturbation or editing of specific target sites through direct detection, analysis and manipulation, in particular in eukaryotic systems, more in particular in mammalian systems (including cells, organs, tissues, or organisms). To utilize the RNA-targeting systems of the present application effectively for RNA targeting without deleterious effects, it is critical to understand aspects of engineering and optimization of these RNA targeting tools.

The Class 2 type VI-B effector protein Cas13b is an RNA-guided RNase that can be efficiently programmed to degrade ssRNA. The present inventors have undertaken screening to identify a representative number of Cas13b orthologs from different species, and to determine efficacy of those orthologs in eukaryotic cellular environments. In various embodiments, the invention refers to, includes, or makes use of a Type VI-B CRISPR-Cas effector protein, or a Cas13b effector protein; as well as to nucleic acids encoding such proteins.

In some embodiments, the effector protein is at least 50%, 60%, 70%, 80%, 85%, 90%, 91%, 92%, 93%, 94%, 95%, 96%, 97%, 98%, 99% or more homologous or identical to a wild type Cas13b effector protein of a prokaryotic organism selected from the group consisting of *Porphyromonas, Prevotella, Bacteroides, Riemerella, Bergeyella, Alistipes, Myroides, Capnocytophaga,* and *Flavobacterium*. In some embodiments, the effector protein is at least 50%, 60%, 70%, 80%, 85%, 90%, 91%, 92%, 93%, 94%, 95%, 96%, 97%, 98%, 99% or more homologous or identical to a wild type Cas13b effector protein of a prokaryotic organism selected from the group consisting of *Porphyromonas gulae, Prevotella* sp., *Porphyromonas gingivalis, Bacteroides pyogenes, Riemerella anatipestifer, Bergeyella zoohelcum, Prevotella intermedia, Prevotella buccae, Alistipes* sp., *Prevotella aurantiaca, Myroides odoratimimus, Capnocytophaga canimorsus, Flavobacterium branchiophilum,* and *Flavobacterium columnare*. In preferred embodiments, the effector protein is at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of *Porphyromonas gulae* Cas13b (accession number WP_039434803), *Prevotella* sp. P5-125 Cas13b (accession number WP_044065294), *Porphyromonas gingivalis* Cas13b (accession number WP_053444417), *Porphyromonas* sp. COT-052 OH4946 Cas13b (accession number WP_039428968), *Bacteroides pyogenes* Cas13b (accession number WP_034542281), *Riemerella anatipestifer* Cas13b (accession number WP_004919755). The most preferred effector proteins are those at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of *Porphyromonas gulae* Cas13b (accession number WP_039434803), *Prevotella* sp. P5-125 Cas13b (accession number WP_044065294), *Porphyromonas gingivalis* Cas13b (accession number WP_053444417), *Porphyromonas* sp. COT-052 OH4946 Cas13b (accession number WP_039428968); and most specifically preferred are *Porphyromonas gulae* Cas13b (accession number WP_039434803) or *Prevotella* sp. P5-125 Cas13b (accession number WP_044065294). The full amino acid sequences of each of these Cas13b effector proteins, and others, is given in FIG. 1.

In some embodiments, the Cas13b effector protein (a) comprises 900-1800 amino acids and two HEPN domains, (b) is naturally present in a prokaryotic genome within 10 kb upstream or downstream of a CRISPR array, (c) is the only encoded protein comprising more than 700 amino acids within 10 kb upstream or downstream of the CRISPR array, and/or (d) there is no Cas1 gene or Cas2 gene within 10 kb upstream or downstream of the CRISPR array. In some embodiments, at least one of Csx27 or Csx28 is also present within 10 kb upstream or downstream of the CRISPR array.

In certain embodiments, the Cas13b effector protein has a modified sequence when compared to a wild-type protein. In certain embodiments, the effector protein is identical to a wild type Cas13b effector protein in at least one or more common motifs shared among two or more Cas13b effector proteins. Common motifs may be determined by standard sequence aligment tools to identify consensus sequences. In particular embodiments, the Cas13b effector protein is a protein comprising a sequence having at least 70% sequence identity with one or more of the sequences consisting of DKHXFGAFLNLARHN (SEQ ID NO:1), GLLFFVSLFLDK (SEQ ID NO:2), SKIXGFK (SEQ ID NO:3), DMLNELXRCP (SEQ ID NO:4), RXZDRFPYFALRYXD (SEQ ID NO: 5) and LRFQVBLGXY (SEQ ID NO:6). In further particular embodiments, the Cas13b effector protein comprises a sequence having at least 70% seqeuence identity at least 2, 3, 4, 5 or all 6 of these sequences. In further particular embodiments, the sequence identity with these sequences is at least 75%, 80%, 85%, 90%, 95% or 100%. In further particular embodiments, the Cas 13b effector protein is a protein comprising a sequence having 100% sequence identity with GLLFFVSLFL (SEQ ID NO:7) and RHQXRFPYF (SEQ ID NO:8). In further particular embodiments, the Cas13b effector is a Cas13b effector protein comprising a sequence having 100% sequence identity with RHQDRFPY (SEQ ID NO:9).

It will be appreciated that the terms Cas enzyme, CRISPR enzyme, CRISPR protein Cas protein and CRISPR Cas are generally used interchangeably and at all points of reference herein refer by analogy to CRISPR effector proteins further described in this application, unless otherwise apparent, such as by specific reference to Cas9.

In embodiments of the invention, a Type VI-B system comprises a Cas13b effector protein and optionally a small accessory protein encoded upstream or downstream of the Cas13b effector protein. In certain embodiments, the small accessory protein enhances the Cas13b effector's ability to target RNA.

In certain embodiments of the invention, a Type VI-B system comprises a Cas13b effector protein and optionally a small accessory protein encoded upstream or downstream of the Cas13b effector protein. In certain embodiments, the small accessory protein repressses the Cas13b effector's ability to target RNA.

The invention provides a non-naturally occurring or engineered composition comprising i) a Type VI-B CRISPR-Cas effector protein, and ii) a Type VI-B CRISPR-Cas crRNA, wherein the crRNA comprises a) a guide sequence that is capable of hybridizing to a target RNA sequence, and b) a direct repeat sequence. The Type VI-B CRISPR-Cas effector protein forms a complex with the crRNA, and the guide sequence directs sequence-specific binding of the complex to the target RNA sequence, whereby there is formed a CRISPR complex comprising the Type VI-B CRISPR-Cas effector protein complexed with the guide sequence that is hybridized to the target RNA sequence. The complex that is formed when the guide sequence hybridizes to the target RNA sequence includes interaction (recognition) of the protospacer flanking sequence (PFS).

In some embodiments, a non-naturally occurring or engineered composition of the invention may comprise a Type VI-B CRISPR-Cas accessory protein that enhances Type VI-B CRISPR-Cas effector protein activity. In certain such embodiments, the accessory protein that enhances Type VI-B CRISPR-Cas effector protein activity is a csx28 protein. In such embodiments, the Type VI-B CRISPR-Cas effector protein and the Type VI-B CRISPR-Cas accessory protein may be from the same source or from a different source.

In some embodiments, a non-naturally occurring or engineered composition of the invention comprises a Type VI-B CRISPR-Cas accessory protein that represses Type VI-B CRISPR-Cas effector protein activity. In certain such embodiment, the accessory protein that represses Type VI-B CRISPR-Cas effector protein activity is a csx27 protein. In such embodiments, the Type VI-B CRISPR-Cas effector protein and the Type VI-B CRISPR-Cas accessory protein may be from the same source or from a different source.

In some embodiments, a non-naturally occurring or engineered composition of the invention comprises two or more Type VI-B CRISPR-Cas crRNAs.

In some embodiments, a non-naturally occurring or engineered composition of the invention comprises a guide sequence that hybridizes to a target RNA sequence in a prokaryotic cell. In some embodiments, a non-naturally occurring or engineered composition of the invention comprises a guide sequence that hybridizes to a target RNA sequence in a eukaryotic cell. The CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, the methods make use of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, the Type VI-B CRISPR-Cas effector protein comprises one or more nuclear localization signals (NLSs).

Cas13b achieves RNA cleavage through conserved basic residues within its two HEPN domains, in contrast to the catalytic mechanisms of other known RNases found in CRISPR-Cas systems. Mutation of the HEPN domain, such as (e.g. alanine) substitution of any of the four predicted HEPN domain catalytic residues can convert Cas13b into an inactive programmable RNA-binding protein (dCas13b, analogous to dCas9).

The ability of dCas13b to bind to specified sequences could be used in several aspects according to the invention to (i) bring effector modules to specific transcripts to modulate the function or translation, which could be used for large-scale screening, construction of synthetic regulatory circuits and other purposes; (ii) fluorescently tag specific RNAs to visualize their trafficking and/or localization; (iii) alter RNA localization through domains with affinity for specific subcellular compartments; and (iv) capture specific transcripts (through direct pull down of dCas13b or use of dCas13b to localize biotin ligase activity to specific transcripts) to enrich for proximal molecular partners, including RNAs and proteins.

Active Cas13b should also have many applications. An aspect of the invention involves targeting a specific transcript for destruction. In addition, Cas13b, once primed by the cognate target, can cleave other (non-complementary) RNA molecules in vitro and can inhibit cell growth in vivo, Biologically, this promiscuous RNase activity may reflect a programmed cell death/dormancy (PCD/D)-based protection mechanism of the type VI-B CRISPR-Cas systems. Accordingly, in an aspect of the invention, it might be used to trigger PCD or dormancy in specific cells—for example, cancer cells expressing a particular transcript, neurons of a given class, cells infected by a specific pathogen, or other aberrant cells or cells the presence of which is otherwise undesirable.

The invention provides a method of modifying nucleic acid sequences associated with or at a target locus of interest, in particular in eukaryotic cells, tissues, organs, or organisms, more in particular in mammalian cells, tissues, organs, or organisms, the method comprising delivering to said locus a non-naturally occurring or engineered composition comprising a Type VI-B CRISPR-Cas loci effector protein and one or more nucleic acid components, wherein the effector protein forms a complex with the one or more nucleic acid components and upon binding of the said complex to the locus of interest the effector protein induces the modification of the sequences associated with or at the target locus of interest. In a preferred embodiment, the modification is the introduction of a strand break. In a preferred embodiment, the sequences associated with or at the target locus of interest comprise RNA and the effector protein is encoded by a type VI-B CRISPR-Cas locus. The complex can be formed in vitro or ex vivo and introduced into a cell or contacted with RNA; or can be formed in vivo.

The invention provides a method of targeting (such as modifying) sequences associated with or at a target locus of interest, the method comprising delivering to said sequences associated with or at the locus a non-naturally occurring or engineered composition comprising a Cas13b loci effector protein (which may be catalytically active, or alternatively catalytically inactive) and one or more nucleic acid components, wherein the Cas13b effector protein forms a complex with the one or more nucleic acid components and upon binding of the said complex to the locus of interest the effector protein induces the modification of sequences associated with or at the target locus of interest. In a preferred embodiment, the modification is the introduction of a strand break. In a preferred embodiment, the Cas13b effector protein forms a complex with one nucleic acid component; advantageously an engineered or non-naturally occurring nucleic acid component. The complex can be formed in vitro or ex vivo and introduced into a cell or contacted with RNA; or can be formed in vivo. The induction of modification of sequences associated with or at the target locus of interest can be Cas13b effector protein-nucleic acid guided. In a preferred embodiment the one nucleic acid component is a CRISPR RNA (crRNA). In a preferred embodiment the one nucleic acid component is a mature crRNA or guide RNA, wherein the mature crRNA or guide RNA comprises a spacer sequence (or guide sequence) and a direct repeat sequence or derivatives thereof. In a preferred embodiment the spacer sequence or the derivative thereof comprises a seed sequence, wherein the seed sequence is critical for recognition and/or hybridization to the sequence at the target locus.

Aspects of the invention relate to Cas13b effector protein complexes having one or more non-naturally occurring or engineered or modified or optimized nucleic acid components. In a preferred embodiment the nucleic acid component of the complex may comprise a guide sequence linked to a direct repeat sequence, wherein the direct repeat sequence comprises one or more stem loops or optimized secondary structures. In one embodiment, the direct repeat sequence may be about 36 nucleotides in length. In a specific embodiment, the direct repeat comprises a GTTG/GUUG at the 5' end that is reverse complementary to a CAAC at the 3' end. In certain embodiments, the direct repeat has a minimum length of 16 nts, such as at least 28 nt, and a single stem loop. In further embodiments the direct repeat has a length longer than 16 nts, preferably more than 17 nts, such as at least 28 nt, and has more than one stem loop or optimized secondary structures. In particular embodiments, the direct repeat has 25 or more nts, such as 26 nt, 27 nt, 28 nt or more, and one or more stem loop structures. In a preferred embodiment the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising QP, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

The invention provides cells comprising Cas13b effector protein and/or guides and or complexes thereof with target nucleic acids, including cells comprising transiently expressed or introduced Cas13b effector protein and/or guides and or complexes thereof. In certain embodiments, the cell is a eukaryotic cell, including but not limited to a yeast cell, a plant cell, a mammalian cell, an animal cell, or a human cell.

The invention also provides a method of modifying a target locus of interest, in particular in eukaryotic cells, tissues, organs, or organisms, more in particular in mammalian cells, tissues, organs, or organisms, the method comprising delivering to said locus a non-naturally occurring or engineered composition comprising a Cas13b loci effector protein and one or more nucleic acid components, wherein the Cas13b effector protein forms a complex with the one or more nucleic acid components and upon binding of the said complex to the locus of interest the effector protein induces the modification of the target locus of interest. In a preferred embodiment, the modification is the introduction of a strand break. The complex can be formed in vitro or ex vivo and introduced into a cell or contacted with RNA; or can be formed in vivo.

In such methods the target locus of interest may be comprised within an RNA molecule. Also, the target locus of interest may be comprised within a DNA molecule, and in certain embodiments, within a transcribed DNA molecule. In such methods the target locus of interest may be comprised in a nucleic acid molecule in vitro.

In such methods the target locus of interest may be comprised in a nucleic acid molecule within a cell, in particular a eukaryotic cell, such as a mammalian cell or a plant cell. The mammalian cell many be a non-human primate, bovine, porcine, rodent or mouse cell. The cell may be a non-mammalian eukaryotic cell such as poultry, fish, or shrimp. The plant cell may be of a crop plant such as cassava, corn, sorghum, wheat, or rice. The plant cell may also be of an algae, tree, or vegetable. The modification introduced to the cell by the present invention may be such that the cell and progeny of the cell are altered for improved production of biologic products such as an antibody, starch, alcohol, or other desired cellular output. The modification introduced to the cell by the present invention may be such that the cell and progeny of the cell include an alteration that changes the biologic product produced.

The mammalian cell may be a non-human mammal, e.g., primate, bovine, ovine, porcine, canine, rodent, Leporidae such as monkey, cow, sheep, pig, dog, rabbit, rat, or mouse cell. The cell may be a non-mammalian eukaryotic cell such as poultry bird (e.g., chicken), vertebrate fish (e.g., salmon) or shellfish (e.g., oyster, clam, lobster, shrimp) cell. The cell may also be a plant cell. The plant cell may be of a monocot or dicot or of a crop or grain plant such as cassava, corn, sorghum, soybean, wheat, oat, or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc.).

The invention provides a method of modifying a target locus of interest, the method comprising delivering to said locus a non-naturally occurring or engineered composition comprising a Type VI-B CRISPR-Cas loci effector protein and one or more nucleic acid components, wherein the effector protein forms a complex with the one or more nucleic acid components and upon binding of the said complex to the locus of interest the effector protein induces the modification of the target locus of interest. In a preferred embodiment, the modification is the introduction of a strand break.

The invention also provides a method of modifying a target locus of interest, the method comprising delivering to said locus a non-naturally occurring or engineered composition comprising a Cas13b loci effector protein and one or more nucleic acid components, wherein the Cas13b effector protein forms a complex with the one or more nucleic acid components and upon binding of the said complex to the locus of interest the effector protein induces the modification of the target locus of interest. In a preferred embodiment, the modification is the introduction of a strand break.

In such methods the target locus of interest may be comprised in a nucleic acid molecule in vitro. In such methods the target locus of interest may be comprised in a nucleic acid molecule within a cell. Preferably, in such methods the target locus of interest may be comprised in an RNA molecule in vitro. Also preferably, in such methods the target locus of interest may be comprised in an RNA molecule within a cell. The cell may be a prokaryotic cell or a eukaryotic cell. The cell may be a mammalian cell. The cell may be a rodent cell. The cell may be a mouse cell.

In any of the described methods the target locus of interest may be a genomic or epigenomic locus of interest. In any of the described methods the complex may be delivered with multiple guides for multiplexed use. In any of the described methods more than one protein(s) may be used.

In further aspects of the invention the nucleic acid components may comprise a CRISPR RNA (crRNA) sequence. Without limitation, the Applicants hypothesize that in such instances, the pre-crRNA may comprise secondary structure that is sufficient for processing to yield the mature crRNA as well as crRNA loading onto the effector protein. By means of example and not limitation, such secondary structure may comprise, consist essentially of or consist of a stem loop within the pre-crRNA, more particularly within the direct repeat.

In any of the described methods the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods the target locus of interest may be a genomic or epigenomic locus of interest. In any of the described methods the complex may be delivered with multiple guides for multiplexed use. In any of the described methods more than one protein(s) may be used.

Regulatory elements may comprise inducible promotors. Polynucleotides and/or vector systems may comprise inducible systems.

In any of the described methods the one or more polynucleotide molecules may be comprised in a delivery system, or the one or more vectors may be comprised in a delivery system.

In any of the described methods the non-naturally occurring or engineered composition may be delivered via liposomes, particles including nanoparticles, exosomes, microvesicles, a gene-gun or one or more viral vectors.

The invention also provides a non-naturally occurring or engineered composition which is a composition having the characteristics as discussed herein or defined in any of the herein described methods.

In certain embodiments, the invention thus provides a non-naturally occurring or engineered composition, such as particularly a composition capable of or configured to modify a target locus of interest, said composition comprising a Type VI-B CRISPR-Cas loci effector protein and one or more nucleic acid components, wherein the effector protein forms a complex with the one or more nucleic acid components and upon binding of the said complex to the locus of interest the effector protein induces the modification of the target locus of interest. In certain embodiments, the effector protein may be a Cas13b loci effector protein.

The invention also provides in a further aspect a non-naturally occurring or engineered composition, such as particularly a composition capable of or configured to modify a target locus of interest, said composition comprising: (a) a guide RNA molecule (or a combination of guide RNA molecules, e.g., a first guide RNA molecule and a second guide RNA molecule, such as for multiplexing) or a nucleic acid encoding the guide RNA molecule (or one or more nucleic acids encoding the combination of guide RNA molecules); (b) a Type VI-B CRISPR-Cas loci effector protein or a nucleic acid encoding the Type VI-B CRISPR-Cas loci effector protein. In certain embodiments, the effector protein may be a Cas13b loci effector protein.

The invention also provides in a further aspect a non-naturally occurring or engineered composition comprising: (a) a guide RNA molecule (or a combination of guide RNA molecules, e.g., a first guide RNA molecule and a second guide RNA molecule) or a nucleic acid encoding the guide RNA molecule (or one or more nucleic acids encoding the combination of guide RNA molecules); (b) be a Cas13b loci effector protein.

The invention also provides a vector system comprising one or more vectors, the one or more vectors comprising one or more polynucleotide molecules encoding components of a non-naturally occurring or engineered composition which is a composition having the characteristics as defined in any of the herein described methods.

The invention also provides a delivery system comprising one or more vectors or one or more polynucleotide molecules, the one or more vectors or polynucleotide molecules comprising one or more polynucleotide molecules encoding components of a non-naturally occurring or engineered composition which is a composition having the characteristics discussed herein or as defined in any of the herein described methods.

The invention also provides a non-naturally occurring or engineered composition, or one or more polynucleotides encoding components of said composition, or vector or delivery systems comprising one or more polynucleotides encoding components of said composition for use in a therapeutic method of treatment. The therapeutic method of treatment may comprise gene or transcriptome editing, or gene therapy.

The invention also provides for methods and compositions wherein one or more amino acid residues of the effector protein may be modified e.g., an engineered or non-naturally-occurring effector protein or Cas13b. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of the RNA strand at the target locus of interest. In a preferred embodiment, the one or more mutations may comprise two mutations. In a preferred embodiment the one or more amino acid residues are modified in a Cas13b effector protein, e.g., an engineered or non-naturally-occurring effector protein or Cas13b. In certain embodiments, the effector protein comprises one or more of the following mutations: R116A, H121A, R1177A, H1182A (wherein amino acid positions correspond to amino acid positions of Cas13b protein originating from *Bergeyella zoohelcum* ATCC 43767), such as R116A, H121A, R1177A, and H1182A; R116A, H121A, and R1177A; R116A, H121A, and H1182A; R116A, R1177A, and H1182A; H121A, R1177A, and H1182A; R116A and H121A; R116A and R1177A; R116A and H1182A; H121A and R1177A; H121A and H1182A; R1177A and H1182A; R116A; H121A; R1177A; H1182A. The skilled person will understand that corresponding amino acid positions in different Cas13b proteins may be mutated to the same effect. In certain embodiments, one or more of mutations R116A, H121A, R1177A, H1182A abolish catalytic activity of the protein completely or partially (e.g. altered cleavage rate, altered specificity, etc.), such as R116A, H121A, R1177A, and H1182A; R116A, H121A, and R1177A; R116A, H121A, and H1182A; R116A, R1177A, and H1182A; H121A, R1177A, and H1182A; R116A and H121A; R116A and R1177A; R116A and H1182A; H121A and R1177A; H121A and H1182A; R1177A and H1182A; R116A; H121A; R1177A; H1182A. In certain embodiments, wherein amino acid positions correspond to amino acid positions of Cas13b protein originating from *Prevotella* sp. P5-125, the effector protein comprises H133A and H1058A mutations. In certain embodiments, the effector protein as described herein is a "dead" effector protein, such as a dead Cas13b effector protein (i.e. dCas13b). In certain embodiments, the effector protein has one or more mutations in HEPN domain 1. In certain embodiments, the effector protein has one or more mutations in HEPN domain 2. In certain embodiments, the effector protein has one or more mutations in HEPN domain 1 and HEPN domain 2. The effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the effector protein (e.g., Cas13b effector protein) and if two or more NLSs, each of the two may be positioned at or near or in proximity to a terminus of the effector protein (e.g., Cas13b effector protein). The one or more heterologous functional domains may comprise one or more transcriptional activation domains. In a preferred embodiment the transcriptional activation domain may comprise VP64.

The one or more heterologous functional domains may comprise one or more transcriptional repression domains. In a preferred embodiment the transcriptional repression domain comprises a KRAB domain or a SID domain (e.g. SID4X). The one or more heterologous functional domains may comprise one or more nuclease domains. In a preferred embodiment a nuclease domain comprises Fok1.

The invention also provides for the one or more heterologous functional domains to have one or more of the following activities: methylase activity, demethylase activity, translation activation activity, translation repression activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

In certain embodiments of the invention, the one or more heterologous functional domains may comprise epitope tags or reporters. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporters include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP).

The invention also provides for the effector protein comprising an effector protein which is at least 50%, 60%, 70%, 80%, 85%, 90%, 91%, 92%, 93%, 94%, 95%, 96%, 97%, 98%, 99% or more homologous or identical to a wild type Cas13b effector protein of a prokaryotic genus selected from the group consisting of *Porphyromonas, Prevotella, Bacteroides, Riemerella, Bergeyella, Alistipes, Myroides, Capnocytophaga,* and *Flavobacterium*. The invention further provides for the effector protein comprising an effector protein which is at least 50%, 60%, 70%, 80%, 85%, 90%, 91%, 92%, 93%, 94%, 95%, 96%, 97%, 98%, 99% or more homologous or identical to a wild type Cas13b effector protein of a prokaryotic species selected from the group consisting of *Porphyromonas gulae, Prevotella* sp., *Porphyromonas gingivalis, Bacteroides pyogenes, Riemerella anatipestifer, Bergeyella zoohelcum, Prevotella intermedia, Prevotella buccae, Alistipes* sp., *Prevotella aurantiaca, Myroides odoratimimus, Capnocytophaga canimorsus, Flavobacterium branchiophilum,* and *Flavobacterium columnare*. The invention additionally provides for the effector protein comprising an effector protein which is at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of *Porphyromonas gulae* Cas13b (accession number WP_039434803), *Prevotella* sp. P5-125 Cas13b (accession number WP_044065294), *Porphyromonas gingivalis* Cas13b (accession number WP_053444417), *Porphyromo-* nas sp. COT-052 OH4946 Cas13b (accession number WP_039428968), *Bacteroides pyogenes* Cas13b (accession number WP_034542281), *Riemerella anatipestifer* Cas13b (accession number WP_004919755). The most preferred effector proteins are those at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of *Porphyromonas gulae* Cas13b (accession number WP_039434803), *Prevotella* sp. P5-125 Cas13b (accession number WP_044065294), *Porphyromonas gingivalis* Cas13b (accession number WP_053444417), *Porphyromonas* sp. COT-052 OH4946 Cas13b (accession number WP_039428968); and most specifically preferred are those at least 50%, 60%, 70%, 80%, 85%, 90%, 91%, 92%, 93%, 94%, 95%, 96%, 97%, 98%, 99% or more homologous or identical to a wild type *Porphyromonas gulae* Cas13b (accession number WP_039434803) or *Prevotella* sp. P5-125 Cas13b (accession number WP_044065294). The effector protein may comprise a chimeric effector protein comprising a first fragment from a first effector protein ortholog and a second fragment from a second effector protein ortholog, and wherein the first and second effector protein orthologs are different.

In certain embodiments, the effector protein may be at least 700 amino acids long. In preferred embodiments, the effector protein may be about 900 to about 1500 amino acids long, e.g., about 900 to about 1000 amino acids long, about 1000 to about 1100 amino acids long, about 1100 to about 1200 amino acids long, or about 1200 to about 1300 amino acids long, or about 1300 to about 1400 amino acids long, or about 1400 to about 1500 amino acids long, e.g., about 900, about 1000, about 1100, about 1200, about 1300, about 1400, about 1500, about 1600, about 1700, or about 1800 amino acids long.

In some embodiments, the Cas13b effector protein (a) comprises 900-1800 amino acids and two HEPN domains, (b) is naturally present in a prokaryotic genome within 10 kb upstream or downstream of a CRISPR array, (c) is the only protein comprising more than 700 amino acids within 10 kb upstream or downstream of the CRISPR array, and/or (d) there is no Cas1 gene or Cas2 gene within 10 kb upstream or downstream of the CRISPR array. In some embodiments, Csx27 or Csx28 is also present within 10 kb upstream or downstream of the CRISPR array.

In certain embodiments, the effector protein, particularly a Type VI-B loci effector protein, more particularly a Cas13b, comprises at least one and preferably at least two, such as more preferably exactly two, conserved RxxxxH motifs. Catalytic RxxxxH motifs are characteristic of HEPN (Higher Eukaryotes and Prokaryotes Nucleotide-binding) domains. Hence, in certain embodiments, the effector protein comprises at least one and preferably at least two, such as more preferably exactly two, HEPN domains. In certain embodiments, the HEPN domains may possess RNAse activity. In other embodiments, the HEPN domains may possess DNAse activity.

In certain embodiments, the Cas13b effector proteins as intended herein may be associated with a locus comprising short CRISPR repeats between 30 and 40 bp long, more typically between 34 and 38 bp long, even more typically between 36 and 37 bp long, e.g., 30, 31, 32, 33, 34, 35, 36, 37, 38, 39, or 40 bp long. In certain embodiments the CRISPR repeats are long or dual repeats between 80 and 350 bp long such as between 80 and 200 bp long, even more typically between 86 and 88 bp long, e.g., 80, 81, 82, 83, 84, 85, 86, 87, 88, 89, or 90 bp long In certain embodiments, a protospacer adjacent motif (PAM) or PAM-like motif directs binding of the effector protein (e.g. a Cas13b effector protein) complex as disclosed herein to the target locus of interest. The PAM may be referred to as a PFS, or protospacer flanking site. In some embodiments, the PAM may be a 5' PAM (i.e., located upstream of the 5' end of the protospacer). In other embodiments, the PAM may be a 3' PAM (i.e., located downstream of the 5' end of the protospacer). In other embodiments, both a 5' PAM and a 3' PAM are required. In certain embodiments of the invention, a PAM or PAM-like motif may not be required for directing binding of the effector protein (e.g. a Cas13b effector protein). In certain embodiments, a 5' PAM is D (i.e. A, G, or U). In certain embodiments, a 5' PAM is D for Type VI-B1 effectors. See Example 1, Table 2. Methods exist to determine consensus 5' and 3' PAMs for a given Cas13b system. In certain embodiments of the invention, cleavage at repeat sequences may generate crRNAs (e.g. short or long crRNAs) containing a full spacer sequence flanked by a short nucleotide (e.g. 5, 6, 7, 8, 9, or 10 nt or longer if it is a dual repeat) repeat sequence at the 5' end (this may be referred to as a crRNA "tag") and the rest of the repeat at the 3' end. In certain embodiments, targeting by the effector proteins described herein may require the lack of homology between the crRNA tag and the target 5' flanking sequence. This requirement may be similar to that described further in Samai et al. "Co-transcriptional DNA and RNA Cleavage during Type III CRISPR-Cas Immunity" Cell 161, 1164-1174, May 21, 2015, where the requirement is thought to distinguish between bona fide targets on invading nucleic acids from the CRISPR array itself, and where the presence of repeat sequences will lead to full homology with the crRNA tag and prevent autoimmunity.

In certain embodiments, the Cas13b effector protein is engineered and can comprise one or more mutations that reduce or eliminate nuclease activity, thereby reducing or eliminating RNA interfering activity. Mutations can also be made at neighboring residues, e.g., at amino acids near those that participate in the nuclease activity. In some embodiments, one or more putative catalytic nuclease domains are inactivated and the effector protein complex lacks cleavage activity and functions as an RNA binding complex. In a preferred embodiment, the resulting RNA binding complex may be linked with one or more functional domains as described herein.

In certain embodiments, the effecteor protein (CRISPR enzyme; Cas13; effector protein) according to the invention as described herein is a catalytically inactive or dead Cas13 effector protein (dCas13). In some embodiments, the dCas13 effector comprises mutations in the nuclease domain. In some embodiments, the dCas13 effector protein has been truncated. In some embodiments, to reduce the size of a fusion protein of the Cas13b effector and the one or more functional domains, the C-terminus of the Cas13b effector can be truncated while still maintaining its RNA binding function. For example, at least 20 amino acids, at least 50 amino acids, at least 80 amino acids, or at least 100 amino acids, or at least 150 amino acids, or at least 200 amino acids, or at least 250 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13b effector. Specific examples of Cas13b truncations include C-terminal Δ984-1090, C-terminal Δ1026-1090, and C-terminal Δ1053-1090, C-terminal A934-1090, C-terminal A884-1090, C-terminal A834-1090, C-terminal A784-1090, and C-terminal A734-1090, wherein amino acid positions correspond to amino acid positions of *Prevotella* sp. P5-125 Cas13b protein. See FIG. 15B.

In certain embodiments, the one or more functional domains are controllable, i.e. inducible.

In certain embodiments of the invention, the guide RNA or mature crRNA comprises, consists essentially of, or consists of a direct repeat sequence and a guide sequence or spacer sequence. In certain embodiments, the guide RNA or mature crRNA comprises, consists essentially of, or consists of a direct repeat sequence linked to a guide sequence or spacer sequence. In preferred embodiments of the invention, the mature crRNA comprises a stem loop or an optimized stem loop structure or an optimized secondary structure. In preferred embodiments the mature crRNA comprises a stem loop or an optimized stem loop structure in the direct repeat sequence, wherein the stem loop or optimized stem loop structure is important for cleavage activity. In certain embodiments, the mature crRNA preferably comprises a single stem loop. In certain embodiments, the direct repeat sequence preferably comprises a single stem loop. In certain embodiments, the cleavage activity of the effector protein complex is modified by introducing mutations that affect the stem loop RNA duplex structure. In preferred embodiments, mutations which maintain the RNA duplex of the stem loop may be introduced, whereby the cleavage activity of the effector protein complex is maintained. In other preferred embodiments, mutations which disrupt the RNA duplex structure of the stem loop may be introduced, whereby the cleavage activity of the effector protein complex is completely abolished.

The invention also provides for the nucleotide sequence encoding the effector protein being codon optimized for expression in a eukaryote or eukaryotic cell in any of the herein described methods or compositions. In an embodiment of the invention, the codon optimized nucleotide sequence encoding the effector protein encodes any Cas13b discussed herein and is codon optimized for operability in a eukaryotic cell or organism, e.g., such cell or organism as elsewhere herein mentioned, for instance, without limitation, a yeast cell, or a mammalian cell or organism, including a mouse cell, a rat cell, and a human cell or non-human eukaryote organism, e.g., plant.

In certain embodiments of the invention, at least one nuclear localization signal (NLS) is attached to the nucleic acid sequences encoding the Cas13b effector proteins. In preferred embodiments at least one or more C-terminal or N-terminal NLSs are attached (and hence nucleic acid molecule(s) coding for the Cas13b effector protein can include coding for NLS(s) so that the expressed product has the NLS(s) attached or connected). In certain embodiments of the invention, at least one nuclear export signal (NES) is attached to the nucleic acid sequences encoding the Cas13b effector proteins. In preferred embodiments at least one or more C-terminal or N-terminal NESs are attached (and hence nucleic acid molecule(s) coding for the Cas13b effector protein can include coding for NES(s) so that the expressed product has the NES(s) attached or connected). In a preferred embodiment a C-terminal and/or N-terminal NLS or NES is attached for optimal expression and nuclear targeting in eukaryotic cells, preferably human cells. In a preferred embodiment, the codon optimized effector protein is Cas13b, and the spacer length of the guide RNA is from 15 to 35 nt. In certain embodiments, the spacer length of the guide RNA is at least 16 nucleotides, such as at least 17 nucleotides, preferably at least 18 nt, such as preferably at least 19 nt, at least 20 nt, at least 21 nt, or at least 22 nt. In certain embodiments, the spacer length is from 15 to 17 nt, from 17 to 20 nt, from 20 to 24 nt, eg. 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is Cas13b, and the direct repeat length of the guide RNA is at least 16 nucleotides. In certain embodiments, the codon optimized effector protein is Cas13b, and the direct repeat length of the guide RNA is from 16 to 20 nt, e.g., 16, 17, 18, 19, or 20 nucleotides. In certain preferred embodiments, the direct repeat length of the guide RNA is 19 nucleotides.

The invention also encompasses methods for delivering multiple nucleic acid components, wherein each nucleic acid component is specific for a different target locus of interest thereby modifying multiple target loci of interest. The nucleic acid component of the complex may comprise one or more protein-binding RNA aptamers. The one or more aptamers may be capable of binding a bacteriophage coat protein. The bacteriophage coat protein may be selected from the group comprising QP, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment the bacteriophage coat protein is MS2. The invention also provides for the nucleic acid component of the complex being 30 or more, 40 or more or 50 or more nucleotides in length.

In a further aspect, the invention provides a eukaryotic cell comprising a modified target locus of interest, wherein the target locus of interest has been modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered expression of at least one gene product; the eukaryotic cell comprising altered expression of at least one gene product, wherein the expression of the at least one gene product is increased; the eukaryotic cell comprising altered expression of at least one gene product, wherein the expression of the at least one gene product is decreased; or the eukaryotic cell comprising an edited genome.

In certain embodiments, the eukaryotic cell may be a mammalian cell or a human cell.

In further embodiments, the non-naturally occurring or engineered compositions, the vector systems, or the delivery systems as described in the present specification may be used for: site-specific gene knockout; site-specific genome editing; RNA sequence-specific interference; or multiplexed genome engineering.

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

Also provided is an engineered and non-naturally occurring eukaryotic cell, comprising at least one of (i) a Cas13b effector protein as described herein, or (ii) a guide RNA capable of forming a CRISPR-Cas complex with a Cas13b effector protein. In some embodiments, (i) and/or (ii) are transiently expressed or introduced into the cell. Also provided are organisms comprising such cells, cell lines, progeny of said cell lines or organisms. The organism may be a vertebrate, for example a mammal. Alternatively, the organism may be a plant or a fungus.

In a further aspect, the invention provides a eukaryotic cell comprising a nucleotide sequence encoding the CRISPR system described herein which ensures the generation of a modified target locus of interest, wherein the target locus of interest is modified according to in any of the herein described methods. A further aspect provides a cell line of said cell. Another aspect provides a multicellular organism comprising one or more said cells.

In certain embodiments, the modification of the target locus of interest may result in: the eukaryotic cell comprising altered (protein) expression of at least one gene product; the eukaryotic cell comprising altered (protein) expression of at least one gene product, wherein the (protein) expression of the at least one gene product is increased; the eukaryotic cell comprising altered (protein) expression of at least one gene product, wherein the (protein) expression of the at least one gene product is decreased; or the eukaryotic cell comprising an edited transcriptome.

In certain embodiments, the eukaryotic cell may be a mammalian cell or a human cell.

In further embodiments, the non-naturally occurring or engineered compositions, the vector systems, or the delivery systems as described in the present specification may be used for RNA sequence-specific interference, RNA sequence specific modulation of expression (including isoform specific expression), stability, localization, functionality (e.g. ribosomal RNAs or miRNAs), etc.; or multiplexing of such processes.

In further embodiments, the non-naturally occurring or engineered compositions, the vector systems, or the delivery systems as described in the present specification may be used for RNA detection and/or quantification in a sample, such as a biological sample. In certain embodiments, RNA detection is in a cell. In an embodiment, the invention provides a method of detecting a target RNA in a sample, comprising (a) incubating the sample with i) a Type VI-B CRISPR-Cas effector protein capable of cleaving RNA, ii) a guide RNA capable of hybridizing to the target RNA, and iii) an RNA-based cleavage inducible reporter capable of being non-specifically and detectably cleaved by the effector protein, (b) detecting said target RNA based on the signal generated by cleavage of said RNA-based cleavage inducible reporter.

In an embodiment the Type VI-B CRISPR-Cas effector protein is a Cas13b effector protein; for example, a Cas13b effector protein as described herein. In an embodiment, the RNA-based cleavage inducible reporter construct comprises a fluorochrome and a quencher. In certain embodiments, the sample comprises a cell-free biological sample. In other embodiments, the sample comprises or a cellular sample, for example, without limitation a plant cell, or an animal cell. In an embodiment of the invention, the target RNA comprises a pathogen RNA, including, but not limited to a target RNA from a virus, bacteria, fungus, or parasite. In an embodiment, the guide RNA is designed to detect a target RNA which comprises a single nucleotide polymorphism or a splice variant of an RNA transcript. In an embodiment, the guide RNA comprises one or more mismatched nucleotides with the target RNA. In certain embodiments, the guide RNA hybridizes to aa target molecule that is diagnostic for a disease state, such as, but not limited to, cancer, or an immune disease.

The invention provides a ribonucleic acid (RNA) detection system, comprising a) a Type VI-B CRISPR-Cas effector protein capable of cleaving RNA, b) a guide RNA capable of binding to a target RNA, and c) an RNA-based cleavage inducible reporter capable of being non-specifically and detectably cleaved by the effector protein. Further, the invention provides a kit for RNA detection, which comprises a) a Type VI-B CRISPR-Cas effector protein capable of cleaving RNA, and b) an RNA-based cleavage inducible reporter capable of being non-specifically and detectably cleaved by the effector protein. In certain embodiments, the RNA-based cleavage inducible reporter construct comprises a fluorochrome and a quencher.

In further embodiments, the non-naturally occurring or engineered compositions, the vector systems, or the delivery systems as described in the present specification may be used for generating disease models and/or screening systems.

In further embodiments, the non-naturally occurring or engineered compositions, the vector systems, or the delivery systems as described in the present specification may be used for: site-specific transcriptome editing or perturbation; nucleic acid sequence-specific interference; or multiplexed genome engineering.

In aspects of the invention, the Cas13b effector proteins, or systems described herein, may be used in the treatment, prevention, prophylaxis, or suppression of viral pathogenesis, infection, or propagation in a mammalian subject. Aspects of the invention provide a Cas13b CRISPR system comprising (a) a Cas13b CRISPR effector protein and/or a polynucleic acid encoding a Cas13b CRISPR effector protein and (b) one or more guide RNAs and/or one or more polynucleic acids encoding one or more guide RNAs designed to bind to one or more target molecules of a virus for use in treating, preventing, suppressing, and/or alleviating viral pathogenesis, infection and/or propagation in a subject. The Cas13b effector protein may be as herein defined, including as to preferred wild-type Cas13b proteins and preferred derivatives and modifications thereof.

In some embodiments, the Cas13b effector proteins, or systems described herein, may be used in the treatment, prevention, prophylaxis, or suppression of Lassa virus pathogenesis, infection, or propagation in a mammalian subject. Lassa virus is associated with DCs and vascular endothelial cells (see Kunz, S. et. al. 2005. *Journal of Virology*).

In some embodiments, the Cas13b effector proteins, or systems described herein, may be used in the treatment, prevention, prophylaxis, or suppression of Ebola virus pathogenesis, infection, or propagation in a mammalian subject. Ebola virus is associated with numerous tissues and cell types including DCs, macrophages, hepatocytes, etc. (see Martines, R. B. et. al. 2015. *Journal of Pathology*).

In some embodiments, the Cas13b effector proteins, or systems described herein, may be used in the treatment, prevention, prophylaxis, or suppression of SARS-CoV pathogenesis, infection, or propagation in a mammalian subject. SARS-CoV is associated with lung tissues and cells (see To, K F. et. al. 2004. *Journal of Pathology*).

In some embodiments, the Cas13b effector proteins, or systems described herein, may be used in the treatment, prevention, prophylaxis, or suppression of Zika virus pathogenesis, infection, or propagation in a mammalian subject. Zika virus is associated with numerous tissues and cell types, including bodily fluids, placenta, brain, etc. (see Miner, J. J. & Diamond, M. S. 2017. *Cell Host & Microbe*).

In some embodiments, the Cas13b effector proteins, or systems described herein, may be used in the treatment, prevention, prophylaxis, or suppression of Dengue virus pathogenesis, infection, or propagation in a mammalian subject. Dengue virus is associated with numerous tissues and cell types, including DCs, macrophages, liver, etc. (see Flipse, J. et. al. 2016. *Journal of General Virology*).

In some embodiments, the Cas13b effector proteins, or systems described herein, may be used in the treatment, prevention, prophylaxis, or suppression of Chikungunya virus pathogenesis, infection, or propagation in a mammalian subject. Chikungunya virus is associated with numerous tissues and cell types, including immune cells, liver, central nervous system, etc. (see Schwartz, O. & Albert, M. L. 2010. *Nature Reviews*).

In some embodiments, the Cas13b effector proteins, or systems described herein, may be used in the treatment, prevention, prophylaxis, or suppression of Influenza virus pathogenesis, infection, or propagation in a mammalian subject. Influenza virus is associated with lung epithelial cells and macrophages (see Medina, R. A. & Garcia-Sastre A. 2011 *Nature Reviews*).

In some embodiments, the Cas13b effector proteins, or systems described herein, may be used in the treatment, prevention, prophylaxis, or suppression of HIV virus pathogenesis, infection, or propagation in a mammalian subject. HIV virus is associated with T cells and macrophages (see Weiss, R. A. 2002. *IUBMB Life*.).

In some embodiments, the Cas13b effector proteins, or systems described herein, may be used in the treatment, prevention, prophylaxis, or suppression of Rotavirus virus pathogenesis, infection, or propagation in a mammalian subject. Rotavirus virus is associated with intestine tissues and cells (see Lopez, S & Arias, C. F. 2006. *CTMI*).

In some embodiments, the Cas13b effector proteins, or systems described herein, may be used in the treatment, prevention, prophylaxis, or suppression of Herpes Simplex (HSV-1) pathogenesis, infection, or propagation in a mammalian subject. HSV-1 is associated with epithelial cells and neuronal cells (see Schelhaas, M. et. al. 2003. *Journal of General Virology*).

In some embodiments, the Cas13b effector proteins, or systems described herein, may be used in the treatment, prevention, prophylaxis, or suppression of HCV pathogenesis, infection, or propagation in a mammalian subject. HCV is associated with liver tissues and cells (see Ding, Q, et. al. 2014. *Cell Host & Microbe*).

In some embodiments, the Cas13b effector proteins, or systems described herein, may be used in the treatment, prevention, prophylaxis, or suppression of HBV pathogenesis, infection, or propagation in a mammalian subject. HBV is associated with liver tissues and cells (see Schieck, A. et. al. 2013. *Hepatology*).

Also provided is a gene product from the cell, the cell line, or the organism as described herein. In certain embodiments, the amount of gene product expressed may be greater than or less than the amount of gene product from a cell that does not have altered expression or edited genome. In certain embodiments, the gene product may be altered in comparison with the gene product from a cell that does not have altered expression or edited genome.

These and other embodiments are disclosed or are obvious from and encompassed by the following Detailed Description.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1 shows a list of wild-type Cas13b orthologs, as well as their amino acid sequences, together with the source organism and the protein accession number.

FIG. 2 shows a classification of each of the Cas13b orthologs of FIG. 1 with their relative efficacy in knockdown of luciferase expression in mammalian cell culture.

FIG. 6: Engineering dCas13b-ADAR fusions for RNA editing. (A) Schematic of RNA editing by dCas13b-ADAR fusion proteins. (B) Schematic of *Cypridina* luciferase W85X target and targeting guide design. (C) Quantification of luciferase activity restoration for Cas13b-dADAR1 (left) and Cas13b-ADAR2-cd (right) with tiling guides of length 30, 50, 70, or 84 nt. (D) Schematic of target site for targeting *Cypridina* luciferase W85X. (E) Sequencing quantification of A→I editing for 50 nt guides targeting *Cypridina* luciferase W85X.

FIG. 7: Measuring sequence flexibility for RNA editing by REPAIRv1. (A) Schematic of screen for determining Protospacer Flanking Site (PFS) preferences of RNA editing by REPAIRv1. (B) Distributions of RNA editing efficiencies for all 4-N PFS combinations at two different editing sites (C) Quantification of the percent editing of REPAIRv1 at Cluc W85 across all possible 3 base motifs. (D) Heatmap of 5' and 3' base preferences of RNA editing at Cluc W85 for all possible 3 base motifs.

FIG. 10: Rational mutagenesis of ADAR2 to improve the specificity of REPAIRv1. (A) Quantification of luciferase signal restoration by various dCas13-ADAR2 mutants as well as their specificity score plotted along a schematic for the contacts between key ADAR2 deaminase residues and the dsRNA target. The specificity score is defined as the ratio of the luciferase signal between targeting guide and non-targeting guide conditions. (B) Quantification of luciferase signal restoration by various dCas13-ADAR2 mutants versus their specificity score. (C) Measurement of the on-target editing fraction as well as the number of significant off-targets for each dCas13-ADAR2 mutant by transcriptome wide sequencing of mRNAs. (D) Transcriptome-wide sites of significant RNA editing by REPAIRv1 and REPAIRv2 with a guide targeting a pretermination site in Cluc. The on-target Cluc site (254 A>G) is highlighted in orange. (E) RNA sequencing reads surrounding the on-target Cluc editing site (254 A>G) highlighting the differences in off-target editing between REPAIRv1 and REPAIRv2. All A>G edits are highlighted in red while sequencing errors are highlighted in blue. (F) RNA editing by REPAIRv1 and REPAIRv2 with guides targeting an out-of-frame UAG site in the endogenous KRAS and PPIB transcripts. The on-target editing fraction is shown as a sideways bar chart on the right for each condition row. The duplex region formed by the guide RNA is shown by a red outline box.

FIG. 11: Bacterial screening of Cas13b orthologs for in vivo efficiency and PFS determination. (A) Schematic of bacterial assay for determining the PFS of Cas13b orthologs. Cas13b orthologs with beta-lactamase targeting spacers are co-transformed with beta-lactamase expression plasmids and subjected to double selection. (B) Quantitation of interference activity of Cas13b orthologs targeting beta-lactamase as measured by colony forming units (cfu). (C) PFS logos for Cas13b orthologs as determined by depleted sequences from the bacterial assay.

FIG. 12: Optimization of Cas13b knockdown and further characterization of mismatch specificity. (A) Gluc knockdown with two different guides is measured using the top 2 Cas13a and top 4 Cas13b orthologs fused to a variety of nuclear localization and nuclear export tags. (B) Knockdown of KRAS is measured for LwaCas13a, RanCas13b, PguCas13b, and PspCas13b with four different guides and compared to four position-matched shRNA controls. (C) Schematic of the single and double mismatch plasmid libraries used for evaluating the specificity of LwaCas13a and PspCas13b knockdown. Every possible single and double mismatch is present in the target sequence as well as in 3 positions directly flanking the 5' and 3' ends of the target site. (D) The depletion level of transcripts with the indicated single mismatches are plotted as a heatmap for both the LwaCas13a and PspCas13b conditions. (E) The depletion level of transcripts with the indicated double mismatches are plotted as a heatmap for both the LwaCas13a and PspCas13b conditions.

FIG. 13: Characterization of design parameters for dCas13-ADAR2 RNA editing. (A) Knockdown efficiency of Gluc targeting for wildtype Cas13b and catalytically inactive H133A/H1058A Cas13b (dCas13b). (B) Quantification of luciferase activity restoration by dCas13b fused to either the wildtype ADAR2 catalytic domain or the hyperactive E488Q mutant ADAR2 catalytic catalytic domain, tested with tiling Cluc targeting guides. (C) Guide design and sequencing quantification of A→I editing for 30 nt guides targeting *Cypridina* luciferase W85X. (D) Guide design and sequencing quantification of A→I editing for 50 nt guides targeting PPIB. (E) Influence of linker choice on luciferase activity restoration by REPAIRv1. (F) Influence of base identify opposite the targeted adenosine on luciferase activity restoration by REPAIRv1.

FIG. 15: (B) Further examples of dCas13b-ADAR constructs with different C-terminal truncations of dCas13b.

FIG. 17: Efficiency and specificity of dCas13b-ADAR2 mutants. (A) Quantitation of luciferase activity restoration by dCas13b-ADAR2 D$_D$(E488Q) mutants for Cluc-targeting and non-targeting guides. (B) Relationship between the ratio of targeting and non-targeting guides and the number of RNA-editing off-targets as quantified by transcriptome-wide sequencing. (C) Quantification of number of transcriptome-wide off-target RNA editing sites versus on-target Cluc editing efficiency for dCas13b-ADAR2$_{DD}$(E488Q) mutants.

FIG. 19: Characterization of motif biases in the off-targets of dCas13b-ADAR2 D$_D$(E488Q) editing. (A) For each dCas13b-ADAR2 D$_D$(E488Q) mutant, the motif present across all A>G off-target edits in the transcriptome is shown. (B) The distribution of off-target A>G edits per motif identity is shown for REPAIRv1 with targeting and non-targeting guide. (C) The distribution of off-target A>G edits per motif identity is shown for REPAIRv2 with targeting and non-targeting guide.

FIG. 20: Further characterization of REPAIRv1 and REPAIRv2 off-targets. (A) Histogram of the number of off-targets per transcript for REPAIRv1. (B) Histogram of the number of off-targets per transcript for REPAIRv2. (C) Variant effect prediction of REPAIRv1 off targets. (D) Distribution of potential oncogenic effects of REPAIRv1 off targets. (E) Variant effect prediction of REPAIRv2 off targets. (F) Distribution of potential oncogenic effects of REPAIRv2 off targets.

FIG. 22: Demonstration of all potential codon changes with a A>G RNA editor. (A) Table of all potential codon transitions enabled by A>I editing. (B) A codon table demonstrating all the potential codon transitions enabled by A>I editing.

Figure 3:
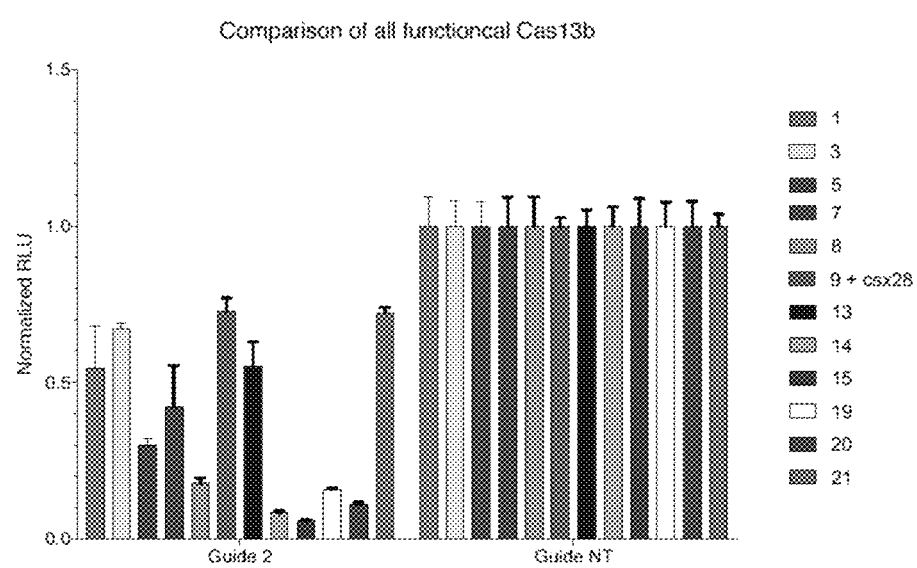
FIG. 3 compares activity of each of the active Cas13b orthologs, controlling for guide sequence.

The figures herein are for illustrative purposes only and are not necessarily drawn to scale.

DETAILED DESCRIPTION OF THE INVENTION

In general, a CRISPR-Cas or CRISPR system as used in the foregoing documents, such as WO 2014/093622 (PCT/US2013/074667) refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system).

When the CRISPR protein is a Class 2 Type VI-B effector (for example, a Cas13b effector protein), a tracrRNA is not required. In an engineered system of the invention, the direct repeat may encompass naturally-occurring sequences or non-naturally-occurring sequences. The direct repeat of the invention is not limited to naturally occurring lengths and sequences. A direct repeat can be 36 nt in length, but a longer or shorter direct repeat can vary. For example, a direct repeat can be 30 nt or longer, such as 30-100 nt or longer. For example, a direct repeat can be 30 nt, 40 nt, 50 nt, 60 nt, 70 nt, 80 nt, 90 nt, 100 nt, or longer in length. In some embodiments, a direct repeat of the invention can include synthetic nucleotide sequences inserted between the 5' and 3' ends of naturally occuring direct repeat. In certain embodiments, the inserted sequence may be self-complementary, for example, 20%, 30%, 40%, 50%, 60%, 70%, 80%, 90%, or 100% self complementary. Furthermore, a direct repeat of the invention may include insertions of nucleotides such as an aptamer or sequences that bind to an adapter protein (for association with functional domains). In certain embodiments, one end of a direct repeat containing such an insertion is roughly the first half of a short DR and the other end is roughly the second half of the short DR.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas13b to a target genomic locus, are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-40 nucleotides long, such as 20-30 or 20-40 nucleotides long or longer, such as 30 nucleotides long or about 30 nucleotides long. In certain embodiments, the guide sequence is 10-30 nucleotides long, such as 20-30 or 20-40 nucleotides long or longer, such as 30 nucleotides long or about 30 nucleotides long for Cas13b effectors. In certain embodiments, the guide sequence is 10-30 nucleotides long, such as 20-30 nucleotides long, such as 30 nucleotides long or about 30 nucleotides long for Cas13b effectors originating from Bergeyella zoohelcum (such as Bergeyella zoohelcum ATCC 43767). The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In a classic CRISPR-Cas system, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length. However, in certain aspects of the invention, off-target interactions may be reduced, e.g., reduce the guide interacting with a target sequence having low complementarity. Indeed, certain mutations may result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence may be greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by chosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

The methods according to the invention as described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s) or sgRNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

For minimization of toxicity and off-target effect, it will be important to control the concentration of Cas mRNA or protein and guide RNA delivered. Optimal concentrations of Cas mRNA or protein and guide RNA can be determined by testing different concentrations in a cellular or non-human eukaryote animal model and using deep sequencing the analyze the extent of modification at potential off-target genomic loci.

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

The nucleic acid molecule encoding a Cas is advantageously codon optimized Cas. An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a Cas is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way how the Cas transgene is introduced in the cell is may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus, such as for instance one or more oncogenic mutations, as for instance and without limitation described in Platt et al. (2014), Chen et al., (2014) or Kumar et al. (2009).

In some embodiments, the Cas sequence is fused to one or more nuclear localization sequences (NLSs) or nuclear export signals (NESs), such as about or more than about 1, 2, 3, 4, 5, 6, 7, 8, 9, 10, or more NLSs or NESs. In some embodiments, the Cas comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g. zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In a preferred embodiment of the invention, the Cas comprises at most 6 NLSs. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 100); the NLS from nucleoplasmin (e.g. the nucleoplasmin bipartite NLS with the sequence KRPAATKKAGQAKKKK) (SEQ ID NO:101); the c-myc NLS having the amino acid sequence PAAKRVKLD (SEQ ID NO: 102) or RQRRNELKRSP (SEQ ID NO:103); the hRNPA1 M9 NLS having the sequence NQSSNFGPMKGGNFGGRSSGPYGGGGQYFAK-PRNQGGY(SEQ ID NO: 104); the sequence RMRIZFKNKGKDTAELRRRRVEVSVELRKAKKD-EQILKRRNV (SEQ ID NO: 105) of the IBB domain from importin-alpha; the sequences VSRKRPRP (SEQ ID NO: 106) and PPKKARED (SEQ ID NO: 107) of the myoma T protein; the sequence PQPKKKPL (SEQ ID NO: 108) of human p53; the sequence SALIKKKKKMAP (SEQ ID NO: 109) of mouse c-abl IV; the sequences DRLRR (SEQ ID NO: 110) and PKQKKRK (SEQ ID NO: 111) of the influenza virus NS1; the sequence RKLKKKIKKL (SEQ ID NO: 112) of the Hepatitis virus delta antigen; the sequence REKKKFLKRR (SEQ ID NO: 113) of the mouse Mx1 protein; the sequence KRKGDEVDGVDEVAKKKSKK (SEQ ID NO: 114) of the human poly(ADP-ribose) polymerase; and the sequence RKCLQAGMNLEARKTKK (SEQ ID NO: 115) of the steroid hormone receptors (human) glucocorticoid. Non-limiting examples of NESs include an NES sequence LYPERLRRILT (SEQ ID NO: 116) (ctgtaccctgagcggctgcggcggatcctgacc (SEQ ID NO: 117)). In general, the one or more NLSs or NESs are of sufficient strength to drive accumulation of the Cas in a detectable amount in respectively the nucleus or the cytoplasm of a eukaryotic cell. In general, strength of nuclear localization/export activity may derive from the number of NLSs/NESs in the Cas, the particular NLS(s) or NES(s) used, or a combination of these factors. Detection of accumulation in the nucleus/cytoplasm may be performed by any suitable technique. For example, a detectable marker may be fused to the Cas, such that location within a cell may be visualized, such as in combination with a means for detecting the location of the nucleus (e.g. a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control no exposed to the Cas or complex, or exposed to a Cas lacking the one or more NLSs or NESs. In certain embodiments, other localization tags may be fused to the Cas protein, such as without limitation for localizing the Cas to particular sites in a cell, such as organelles, such mitochondria, plastids, chloroplast, vesicles, golgi, (nuclear or cellular) membranes, ribosomes, nucleoluse, ER, cytoskeleton, vacuoles, centrosome, nucleosome, granules, centrioles, etc.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (www.genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxfordjournals.org/content/34/7/e53.short, www.nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters-especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

Aspects of the invention relate to the identification and engineering of novel effector proteins associated with Class 2 CRISPR-Cas systems. In a preferred embodiment, the effector protein comprises a single-subunit effector module. In a further embodiment the effector protein is functional in prokaryotic or eukaryotic cells for in vitro, in vivo or ex vivo applications.

The term "nucleic acid-targeting system", wherein nucleic acid is DNA or RNA, and in some aspects may also refer to DNA-RNA hybrids or derivatives thereof, refers collectively to transcripts and other elements involved in the expression of or directing the activity of DNA or RNA-targeting CRISPR-associated ("Cas") genes, which may include sequences encoding a DNA or RNA-targeting Cas protein and a DNA or RNA-targeting guide RNA comprising a CRISPR RNA (crRNA) sequence and (in some but not all systems) a trans-activating CRISPR/Cas system RNA (tracrRNA) sequence, or other sequences and transcripts from a DNA or RNA-targeting CRISPR locus. In general, an RNA-targeting system is characterized by elements that promote the formation of a DNA or RNA-targeting complex at the site of a target DNA or RNA sequence. In the context of formation of a DNA or RNA-targeting complex, "target sequence" refers to a DNA or RNA sequence to which a DNA or RNA-targeting guide RNA is designed to have complementarity, where hybridization between a target sequence and an RNA-targeting guide RNA promotes the formation of an RNA-targeting complex. In some embodiments, a target sequence is located in the nucleus or cytoplasm of a cell.

In an aspect of the invention, novel RNA targeting systems also referred to as RNA- or RNA-targeting CRISPR/Cas or the CRISPR-Cas system RNA-targeting system of the present application are based on identified Type VI-B Cas proteins which do not require the generation of customized proteins to target specific RNA sequences but rather a single enzyme can be programmed by an RNA molecule to recognize a specific RNA target, in other words the enzyme can be recruited to a specific RNA target using said RNA molecule.

In an aspect of the invention, novel DNA targeting systems also referred to as DNA- or DNA-targeting CRISPR/Cas or the CRISPR-Cas system RNA-targeting system of the present application are based on identified Type VI-B Cas proteins which do not require the generation of customized proteins to target specific RNA sequences but rather a single enzyme can be programmed by an RNA molecule to recognize a specific DNA target, in other words the enzyme can be recruited to a specific DNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing, trafficking of target nucleic acids, tracing of target nucleic acids, isolation of target nucleic acids, visualization of target nucleic acids, etc.

As used herein, a Cas protein or a CRISPR enzyme refers to any of the proteins presented in the new classification of CRISPR-Cas systems.

Cas13b Nucleases

The Cas13b effector protein of the invention is, or comprises, or consists essentially of, or consists of, or involves or relates to such a protein from or as set forth in FIG. 1. Preferred proteins of FIG. 1 are selected from the group consisting of *Porphyromonas gulae* Cas13b (accession number WP_039434803), *Prevotella* sp. P5-125 Cas13b (accession number WP_044065294), *Porphyromonas gingivalis* Cas13b (accession number WP_053444417), *Porphyromonas* sp. COT-052 OH4946 Cas13b (accession number WP_039428968), *Bacteroides pyogenes* Cas13b (accession number WP_034542281), *Riemerella anatipestifer* Cas13b (accession number WP_004919755). The most preferred proteins of FIG. 1 are selected from the group consisting of *Porphyromonas gulae* Cas13b (accession number WP_039434803), *Prevotella* sp. P5-125 Cas13b (accession number WP_044065294), *Porphyromonas gingivalis*

Cas13b (accession number WP_053444417), *Porphyromonas* sp. COT-052 OH4946 Cas13b (accession number WP_039428968); and most specifically preferred are *Porphyromonas gulae* Cas13b (accession number WP_039434803) or *Prevotella* sp. P5-125 Cas13b (accession number WP_044065294). This invention is intended to provide, or relate to, or involve, or comprise, or consist essentially of, or consist of, a protein from or as set forth herein, including mutations or alterations thereof as set forth herein Thus, in some embodiments, the effector protein may be an RNA-binding protein, such as a dead-Cas type effector protein, which may be optionally functionalised as described herein for instance with an transcriptional activator or repressor domain, NLS or other functional domain. In some embodiments, the effector protein may be an RNA-binding protein that cleaves a single strand of RNA. If the RNA bound is ssRNA, then the ssRNA is fully cleaved. In some embodiments, the effector protein may be an RNA-binding protein that cleaves a double strand of RNA, for example if it comprises two RNase domains. If the RNA bound is dsRNA, then the dsRNA is fully cleaved.

RNase function in CRISPR systems is known, for example mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA.

Cas13b Guide

As used herein, the term "crRNA" or "guide RNA" or "single guide RNA" or "sgRNA" or "one or more nucleic acid components" of a Type VI CRISPR-Cas locus effector protein comprises any polynucleotide sequence having sufficient complementarity with a target nucleic acid sequence to hybridize with the target nucleic acid sequence and direct sequence-specific binding of an RNA-targeting complex to the target RNA sequence.

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, guides of the invention comprise non-naturally occurring nucleic acids and/or non-naturally occurring nucleotides and/or nucleotide analogs, and/or chemically modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine (ψ), N1-methylpseudouridine (me1ψ), 5-methoxyuridine (5moU), inosine, 7-methylguanosine. Examples of guide RNA chemical modifications include, without limitation, incorporation of 2'-O-methyl (M), 2'-O-methyl 3'phosphorothioate (MS), S-constrained ethyl (cEt), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015; Allerson et al., J. Med. Chem. 2005, 48:901-904; Bramsen et al., Front. Genet., 2012, 3:154; Deng et al., PNAS, 2015, 112:11870-11875; Sharma et al., MedChemComm., 2014, 5:1454-1471; Li et al., Nature Biomedical Engineering, 2017, 1, 0066 DOI:10.1038/s41551-017-0066).

In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233: 74-83). In certain embodients, a guide comprises ribonucleotides in a region that binds to a target RNA and one or more deoxyribonucletides and/or nucleotide analogs in a region that binds to Cas13b. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 3'-handle of the stem-loop regions. Chemical modification in the 3'-handle of the stem-loop region of a guide may abolish its function. In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 5' and/or the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to, amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554)

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromouridine, pseudouridine (ψ), N1-methylpseudouridine (melψ), 5-methoxyuridine (5moU), inosine, 7-methylguanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 5'-terminus are chemically modified. In certain embodiments, none of the nucleotides in the 3'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 5'-terminus are chemically modified. Such chemical modifications at the 5'-terminus of the Cas13b CrRNA may improve gene cutting efficiency. In a specific embodiment, 5 nucleotides in the 5'-terminus are replaced with 2'-fluoro analogues. In a specific embodiment, 10 nucleotides in the 5'-terminus are replaced with 2'-fluoro analogues. In a specific embodiment, 5 nucleotides in the 5'-terminus are replaced with 2'-O-methyl (M) analogs.

In some embodiments, the loop of the 3'-handle of the guide is modified. In some embodiments, the loop of the 3'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

In one aspect, the guide comprises portions that are chemically linked or conjugated via a non-phosphodiester bond. In one aspect, the guide comprises, in non-limiting examples, a direct repeat and a targeting sequence portion that are chemically linked or conjugated via a non-nucleotide loop. In some embodiments, the portions are joined via a non-phosphodiester covalent linker. Examples of the covalent linker include but are not limited to a chemical moiety selected from the group consisting of carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, portions of the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, the non-targeting guide portions can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thiolsemicarbazide, thiol, maleimide, haloalkyl, sufonyl, ally, propargyl, diene, alkyne, and azide. Once a non-targeting portions of a guide is functionalized, a covalent chemical bond or linkage can be formed between the two oligonucleotides. Examples of chemical bonds include, but are not limited to, those based on carbamates, ethers, esters, amides, imines, amidines, aminotriazines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, one or more portions of a guide can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In some embodiments, the guide portions can be covalently linked using various bioconjugation reactions, loops, bridges, and non-nucleotide links via modifications of sugar, internucleotide phosphodiester bonds, purine and pyrimidine residues. Sletten et al., Angew. Chem. Int. Ed. (2009) 48:6974-6998; Manoharan, M. Curr. Opin. Chem. Biol. (2004) 8: 570-9; Behlke et al., Oligonucleotides (2008) 18: 305-19; Watts, et al., Drug. Discov. Today (2008) 13: 842-55; Shukla, et al., ChemMedChem (2010) 5: 328-49.

In some embodiments, the guide portions can be covalently linked using click chemistry. In some embodiments, guide portions can be covalently linked using a triazole linker. In some embodiments, guide portions can be covalently linked using Huisgen 1,3-dipolar cycloaddition reaction involving an alkyne and azide to yield a highly stable triazole linker (He et al., ChemBioChem (2015) 17: 1809-1812; WO 2016/186745). In some embodiments, guide portions are covalently linked by ligating a 5'-hexyne portion and a 3'-azide portion. In some embodiments, either or both of the 5'-hexyne guide portion and a 3'-azide guide portion can be protected with 2'-acetoxyethl orthoester (2'-ACE) group, which can be subsequently removed using Dharmacon protocol (Scaringe et al., J. Am. Chem. Soc. (1998) 120: 11820-11821; Scaringe, Methods Enzymol. (2000) 317: 3-18).

In some embodiments, guide portions can be covalently linked via a linker (e.g., a non-nucleotide loop) that comprises a moiety such as spacers, attachments, bioconjugates, chromophores, reporter groups, dye labeled RNAs, and non-naturally occurring nucleotide analogues. More specifically, suitable spacers for purposes of this invention include, but are not limited to, polyethers (e.g., polyethylene glycols, polyalcohols, polypropylene glycol or mixtures of efhylene and propylene glycols), polyamines group (e.g., spennine, spermidine and polymeric derivatives thereof), polyesters (e.g., poly(ethyl acrylate)), polyphosphodiesters, alkylenes, and combinations thereof. Suitable attachments include any moiety that can be added to the linker to add additional properties to the linker, such as but not limited to, fluorescent labels. Suitable bioconjugates include, but are not limited to, peptides, glycosides, lipids, cholesterol, phospholipids, diacyl glycerols and dialkyl glycerols, fatty acids, hydrocarbons, enzyme substrates, steroids, biotin, digoxigenin, carbohydrates, polysaccharides. Suitable chromophores, reporter groups, and dye-labeled RNAs include, but are not limited to, fluorescent dyes such as fluorescein and rhodamine, chemiluminescent, electrochemiluminescent, and bioluminescent marker compounds. The design of example linkers conjugating two RNA components are also described in WO 2004/015075.

The linker (e.g., a non-nucleotide loop) can be of any length. In some embodiments, the linker has a length equivalent to about 0-16 nucleotides. In some embodiments, the linker has a length equivalent to about 0-8 nucleotides. In some embodiments, the linker has a length equivalent to about 0-4 nucleotides. In some embodiments, the linker has a length equivalent to about 2 nucleotides. Example linker design is also described in WO2011/008730.

In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within an RNA-targeting guide RNA or crRNA) to direct sequence-specific binding of a nucleic acid-targeting complex to a target nucleic acid sequence may be assessed by any suitable assay. For example, the components of an RNA-targeting CRISPR Cas13b system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence an RNA-targeting guide RNA or crRNA, may be selected to target any target nucleic acid sequence. The target sequence may be DNA. The target sequence may be any RNA sequence. In some embodiments, the target sequence may be a sequence within an RNA molecule selected from the group consisting of messenger RNA (mRNA), pre-mRNA, ribosomaal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, an RNA-targeting guide RNA or crRNA is selected to reduce the degree secondary structure within the RNA-targeting guide RNA or crRNA. In some embodiments, about or less than about 75%, 50%, 40%, 30%, 25%, 20%, 15%, 10%, 5%, 1%, or fewer of the nucleotides of the RNA-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence. In other embodiments, multiple DRs (such as dual DRs) may be present.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

Interfering RNA (RNAi) and microRNA (miRNA)

In other embodiments, the target RNA may include interfering RNA, i.e. RNA involved in an RNA interference pathway, such as shRNA, siRNA and so forth, both in eukaryotes and prokaryotes. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

In certain embodiments, the target is not the miRNA itself, but the miRNA binding site of a miRNA target.

In certain embodiments, miRNAs may be sequestered (such as including subcellularly relocated). In certain embodiments, miRNAs may be cut, such as without limitation at hairpins.

In certain embodiments, miRNA processing (such as including turnover) is increased or decreased.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

The protein system of the invention can be applied in areas of RNAi technologies, without undue experimentation, from this disclosure, including therapeutic, assay and other applications (see, e.g., Guidi et al., PLoS Negl Trop Dis 9(5): e0003801. doi:10.1371/journal.pntd; Crotty et al., In vivo RNAi screens: concepts and applications. Shane Crotty . . . 2015 Elsevier Ltd. Published by Elsevier Inc., Pesticide Biochemistry and Physiology (Impact Factor: 2.01). 01/2015; 120. DOI: 10.1016/j.pestbp.2015.01.002 and Makkonen et al., Viruses 2015, 7(4), 2099-2125; doi: 10.3390/v7042099), because the present application provides the foundation for informed engineering of the system.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

In some embodiments, the effector protein may be an RNA-binding protein, optionally functionalized, as described herein. In some embodiments, the effector protein may be an RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome. In particular, reduction of ribosomal activity is envisaged. This may be useful in assaying ribosomal function in vivo or in vitro, but also as a means of controlling therapies based on ribosomal activity, in vivo or in vitro. Furthermore, control (i.e. reduction) of protein synthesis in an in vivo or in vitro system is envisaged, such control including antibiotic and research and diagnostic use.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged. This may be useful in assaying riboswitch function in vivo or in vitro, but also as a means of controlling therapies based on riboswitch activity, in vivo or in vitro. Furthermore, control (i.e. reduction) of protein synthesis in an in vivo or in vitro system is envisaged. This control, as for rRNA may include antibiotic and research and diagnostic use.

Ribozymes

Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be an RNA-binding protein cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged. This may be useful in assaying ribozymal function in vivo or in vitro, but also as a means of controlling therapies based on ribozymal activity, in vivo or in vitro.

Gene Expression, Including RNA Processing

The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of satellite viruses, bacteriophages and retroviruses, such as HBV, HBC and HIV and others listed herein) including viroids in plants; and tRNA biosynthesis. The effector protein and suitable guide may also be used to control RNA activation (RNAa). RNAa leads to the promotion of gene expression, so control of gene expression may be achieved that way through disruption or reduction of RNAa and thus less promotion of gene expression. This is discussed more in detail below.

RNAi Screens

Identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of mRNA targets (and corresponding disease treatments) are VEGF, VEGF-R1 and RTP801 (in the treatment of AMD and/or DME), Caspase 2 (in the treatment of NAION), ADRB2 (in the treatment of intraocular pressure), TRPVI (in the treatment of Dry eye syndrome, Syk kinase (in the treatment of asthma), Apo B (in the treatment of hypercholesterolemia or hypobetalipoproteinemia), PLK1, KSP and VEGF (in the treatment of solid tumors), Ber-Abl (in the treatment of CML) (Burnett and Rossi Chem Biol. 2012, 19(1): 60-71)). Similarly, RNA targeting has been demonstrated to be effective in the treatment of RNA-virus mediated diseases such as HIV (targeting of HIV Tet and Rev), RSV (targeting of RSV nucleocapsid) and HCV (targeting of miR-122) (Burnett and Rossi Chem Biol. 2012, 19(1): 60-71).

It is further envisaged that the RNA targeting effector protein of the invention can be used for mutation specific or allele specific knockdown. Guide RNA's can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD.

It is noted that in this context, and more generally for the various applications as described herein, the use of a split version of the RNA targeting effector protein can be envisaged. Indeed, this may not only allow increased specificity but may also be advantageous for delivery. The Cas13b is split in the sense that the two parts of the Cas13b enzyme substantially comprise a functioning Cas13b. Ideally, the split should always be so that the catalytic domain(s) are unaffected. That Cas13b may function as a nuclease or it may be a dead-Cas13b which is essentially an RNA-binding protein with very little or no catalytic activity, due to typically mutation(s) in its catalytic domains.

Each half of the split Cas13b may be fused to a dimerization partner. By means of example, and without limitation, employing rapamycin sensitive dimerization domains, allows to generate a chemically inducible split Cas13b for temporal control of Cas13b activity. Cas13b can thus be rendered chemically inducible by being split into two fragments and that rapamycin-sensitive dimerization domains may be used for controlled reassembly of the Cas13b. The two parts of the split Cas13b can be thought of as the N' terminal part and the C' terminal part of the split Cas13b. The fusion is typically at the split point of the Cas13b. In other words, the C' terminal of the N' terminal part of the split Cas13b is fused to one of the dimer halves, whilst the N' terminal of the C' terminal part is fused to the other dimer half.

The Cas13b does not have to be split in the sense that the break is newly created. The split point is typically designed in silico and cloned into the constructs. Together, the two parts of the split Cas13b, the N' terminal and C' terminal parts, form a full Cas13b, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired Cas13b function is restored or reconstituted. The dimer may be a homodimer or a heterodimer.

In certain embodiments, the Cas13b effector as described herein may be used for mutation-specific, or allele-specific targeting, such as, for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the message.

Modulation of Gene Expression Through Modulation of RNA Function

Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the mRNA. Similarly in the context of therapy, it can be envisaged to address (pathogenic) malfunctioning at each of these levels by using RNA-specific targeting molecules. In these embodiments it is in many cases preferred that the RNA targeting protein is a "dead" Cas13b that has lost the ability to cut the RNA target but maintains its ability to bind thereto, such as the mutated forms of Cas13b described herein.

A) Alternative Splicing

Many of the human genes express multiple mRNAs as a result of alternative splicing. Different diseases have been shown to be linked to aberrant splicing leading to loss of function or gain of function of the expressed gene. While some of these diseases are caused by mutations that cause splicing defects, a number of these are not. One therapeutic option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

An RNA targeting effector protein binding to a target RNA can sterically block access of splicing factors to the RNA sequence. The RNA targeting effector protein targeted to a splice site may block splicing at the site, optionally redirecting splicing to an adjacent site. For instance, an RNA targeting effector protein binding to the 5' splice site binding can block the recruitment of the U1 component of the spliceosome, favoring the skipping of that exon. Alternatively, an RNA targeting effector protein targeted to a splicing enhancer or silencer can prevent binding of trans-acting regulatory splicing factors at the target site and effectively block or promote splicing. Exon exclusion can further be achieved by recruitment of ILF2/3 to precursor mRNA near an exon by an RNA targeting effector protein as described herein. As yet another example, a glycine rich domain can be attached for recruitment of hnRNP A1 and exon exclusion (Del Gatto-Konczak et al. Mol Cell Biol. 1999 January; 19(1):251-60).

In certain embodiments, through appropriate selection of gRNA, specific splice variants may be targeted, while other splice variants will not be targeted.

In some cases the RNA targeting effector protein can be used to promote slicing (e.g. where splicing is defective). For instance, an RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA or RNA.

Examples of diseases which have been associated with aberrant splicing include, but are not limited to, Paraneoplastic Opsoclonus Myoclonus Ataxia (or POMA), resulting from a loss of Nova proteins which regulate splicing of proteins that function in the synapse, and Cystic Fibrosis, which is caused by defective splicing of a cystic fibrosis transmembrane conductance regulator, resulting in the production of nonfunctional chloride channels. In other diseases aberrant RNA splicing results in gain-of-function. This is the case for instance in myotonic dystrophy which is caused by a CUG triplet-repeat expansion (from 50 to >1500 repeats) in the 3'UTR of an mRNA, causing splicing defects.

The RNA targeting effector protein can be used to include an exon by recruiting a splicing factor (such as U1) to a 5'splicing site to promote excision of introns around a desired exon. Such recruitment could be mediated trough a fusion with an arginine/serine rich domain, which functions as splicing activator (Gravely B R and Maniatis T, Mol Cell. 1998 (5):765-71).

It is envisaged that the RNA targeting effector protein can be used to block the splicing machinery at a desired locus, resulting in preventing exon recognition and the expression of a different protein product. An example of a disorder that may treated is Duchenne muscular dystrophy (DMD), which is caused by mutations in the gene encoding for the dystrophin protein. Almost all DMD mutations lead to frameshifts, resulting in impaired dystrophin translation. The RNA targeting effector protein can be paired with splice junctions or exonic splicing enhancers (ESEs) thereby preventing exon recognition, resulting in the translation of a partially functional protein. This converts the lethal Duchenne phenotype into the less severe Becker phenotype.

B) RNA Modification

RNA editing is a natural process whereby the diversity of gene products of a given sequence is increased by minor modification in the RNA. Typically, the modification involves the conversion of adenosine (A) to inosine (I), resulting in an RNA sequence which is different from that encoded by the genome. RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70).

According to the invention, enzymatic approaches are used to induce transitions (A↔G or C↔U changes) or transversions (any purine to any pyrimidine of vice versa) in the RNA bases of a given transcript. Transitions can be directly induced by using adenosine (ADAR1/2)) or cytosine deaminases (APOBEC, AID) which convert A to I or C to U, respectively. Transversions can be indirectly induced by localizing reactive oxygen species damage to the bases of interest, which causes chemical modifications to be added to the affected bases, such as the conversion of guanine to oxo-guanine. An oxo-guanine is recognized as a T and will, thus, base pair with an adenine causing translation to be affected. Proteins that can be recruited for ROS-mediated base damage include APEX and mini-SOG. With both approaches, these effectors can be fused to a catalytically inactive Cas13b and be recruited to sites on transcripts where these types of mutations are desired.

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

C) Polyadenylation

Polyadenylation of an mRNA is important for nuclear transport, translation efficiency and stability of the mRNA, and all of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

Examples of diseases which have been linked to defective proteins involved in polyadenylation are oculopharyngeal muscular dystrophy (OPMD) (Brais B, et al. Nat Genet. 1998; 18:164-7).

D) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in *Xenopus* (Katahira J, et al. EMBO J. 1999; 18:2593-609).

E) mRNA Localization mRNA localization ensures spatially regulated protein production. Localization of transcripts to a specific region of the cell can be ensured by localization elements. In particular embodiments, it is envisaged that the effector proteins described herein can be used to target localization elements to the RNA of interest. The effector proteins can be designed to bind the target transcript and shuttle them to a location in the cell determined by its peptide signal tag. More particularly for instance, an RNA targeting effector protein fused to one or more nuclear localization signal (NLS) and/or one or more nuclear export signal (NES) can be used to alter RNA localization.

Further examples of localization signals include the zipcode binding protein (ZBP1) which ensures localization of β-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the effector protein to an appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

F) Translation

The RNA targeting effector proteins described herein can be used to enhance or repress translation. It is envisaged that upregulating translation is a very robust way to control cellular circuits. Further, for functional studies a protein translation screen can be favorable over transcriptional upregulation screens, which have the shortcoming that upregulation of transcript does not translate into increased protein production.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EMBO J. 1999; 18(17):4865-74 for a non-reprogrammable RNA binding protein). As another example, GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5' UTR regions of an RNA transcript and preventing the ribosome from forming and beginning translation.

Further, the RNA targeting effector protein can be used to recruit Caf1, a component of the CCR4-NOT deadenylase complex, to the target mRNA, resulting in deadenylation or the target transcript and inhibition of protein translation.

For instance, the RNA targeting effector protein of the invention can be used to increase or decrease translation of therapeutically relevant proteins. Examples of therapeutic applications wherein the RNA targeting effector protein can be used to downregulate or upregulate translation are in amyotrophic lateral sclerosis (ALS) and cardiovascular disorders. Reduced levels of the glial glutamate transporter EAAT2 have been reported in ALS motor cortex and spinal cord, as well as multiple abnormal EAAT2 mRNA transcripts in ALS brain tissue. Loss of the EAAT2 protein and function thought to be the main cause of excitotoxicity in ALS. Restoration of EAAT2 protein levels and function may provide therapeutic benefit. Hence, the RNA targeting effector protein can be beneficially used to upregulate the expression of EAAT2 protein, e.g. by blocking translational repressors or stabilizing mRNA as described above. Apolipoprotein A1 is the major protein component of high density lipoprotein (HDL) and ApoA1 and HDL are generally considered as atheroprotective. It is envisages that the RNA targeting effector protein can be beneficially used to upregulate the expression of ApoA1, e.g. by blocking translational repressors or stabilizing mRNA as described above.

G) mRNA Turnover

Translation is tightly coupled to mRNA turnover and regulated mRNA stability. Specific proteins have been described to be involved in the stability of transcripts (such as the ELAV/Hu proteins in neurons, Keene J D, 1999, Proc Natl Acad Sci USA. 96:5-7) and tristetraprolin (TTP). These proteins stabilize target mRNAs by protecting the messages from degradation in the cytoplasm (Peng S S et al., 1988, EMBO J. 17:3461-70).

It can be envisaged that the RNA-targeting effector proteins of the present invention can be used to interfere with or to promote the activity of proteins acting to stabilize mRNA transcripts, such that mRNA turnover is affected. For instance, recruitment of human TTP to the target RNA using the RNA targeting effector protein would allow for adenylate-uridylate-rich element (AU-rich element) mediated translational repression and target degradation. AU-rich elements are found in the 3' UTR of many mRNAs that code for proto-oncogenes, nuclear transcription factors, and cytokines and promote RNA stability. As another example, the RNA targeting effector protein can be fused to HuR, another mRNA stabilization protein (Hinman M N and Lou H, Cell Mol Life Sci 2008; 65:3168-81), and recruit it to a target transcript to prolong its lifetime or stabilize short-lived mRNA.

It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

Patients with paraneoplastic neurological disorder (PND)-associated encephalomyelitis and neuropathy are patients who develop autoantibodies against Hu-proteins in tumors outside of the central nervous system (Szabo A et al. 1991, Cell.; 67:325-33 which then cross the blood-brain barrier. It can be envisaged that the RNA-targeting effector proteins of the present invention can be used to interfere with the binding of autoantibodies to mRNA transcripts.

Patients with dystrophy type 1 (DM1), caused by the expansion of (CUG)n in the 3' UTR of dystrophia myotonica-protein kinase (DMPK) gene, are characterized by the accumulation of such transcripts in the nucleus. It is envisaged that the RNA targeting effector proteins of the invention fused with an endonuclease targeted to the (CUG)n repeats could inhibit such accumulation of aberrant transcripts.

H) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

I) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments Cas13b in a complex with crRNA is activated upon binding to target RNA and subsequently cleaves any nearby ssRNA targets (i.e. "collateral" or "bystander" effects). Cas13b, once primed by the cognate target, can cleave other (non-complementary) RNA molecules. Such promiscuous RNA cleavage could potentially cause cellular toxicity, or otherwise affect cellular physiology or cell status.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation, In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in incuction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub)populations, or cell/tissue types expressing one or more target sequences, such as one or more particular target RNA (e.g. ss RNA). Without limitation, target cells may for instance be cancer cells expressing a particular transcript, e.g. neurons of a given class, (immune) cells causing e.g. autoimmunity, or cells infected by a specific (e.g. viral) pathogen, etc.

Accordingly, in certain embodiments, the invention relates to a method for treating a pathological condition characterized by the presence of undersirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undersirable cells (host cells). In certain embodiments, the invention relates the non-naturally occurring or engineered composition, vector system, or delivery systems as described herein for use in treating a pathological condition characterized by the presence of undersirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating cancer. In certain embodiments, the invention relates to the non-naturally occurring or engineered composition, vector system, or delivery systems as described herein for use in treating, preventing, or alleviating cancer. In certain embodiments, the invention relates to a method for treating, preventing, or alleviating cancer comprising introducing or inducing the non-naturally occurring or engineered composition, vector system, or delivery systems as described herein. It is to be understood that preferably the CRISPR-Cas system targets a target specific for the cancer cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). In certain embodiments, the invention relates to the use of the non-naturally occurring or engineered composition, vector system, or delivery systems as described herein for treating, preventing, or alleviating an autoimmune disorder. In certain embodiments, the invention relates to the non-naturally occurring or engineered composition, vector system, or delivery systems as described herein for use in treating, preventing, or alleviating an autoimmune disorder. In certain embodiments, the invention relates to a method for treating, preventing, or alleviating an autoimmune disorder comprising introducing or inducing the non-naturally occurring or engineered composition, vector system, or delivery systems as described herein. It is to be understood that preferably the CRISPR-Cas system targets a target specific for the cells responsible for the autoimmune disorder (e.g. specific immune cells).

Use of RNA-Targeting Effector Protein in RNA Detection or Protein Detection

It is further envisaged that the RNA targeting effector protein can be used for detection of nucleic acids or proteins in a biological sample. The samples can be cellular or cell-free.

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

An RNA targeting effector protein can also be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted form a split intein.

RNA targeting effector proteins are for instance suitably used to determine the localization of the RNA or specific splice variants, the level of mRNA transcript, up- or down regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. inhibition of cancer growth using molecular inhibitors or hypoxic conditions on cells. Another application would be to track localization of transcripts to synaptic connections during a neural stimulus using two photon microscopy.

In certain embodiments, the components or complexes according to the invention as described herein can be used in multiplexed error-robust fluorescence in situ hybridization (MERFISH; Chen et al. Science; 2015; 348(6233)), such as for instance with (fluorescently) labeled Cas13b effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can for instance be used to target a probe to a selected RNA sequence.

These applications could also be applied in animal models for in vivo imaging of disease relevant applications or difficult-to culture cell types.

The invention provides agents and methods for diagnosing and monitoring health states through non-invasive sampling of cell free RNA, including testing for risk and guiding RNA-targeted therapies, and is useful in setting where rapid administration of therapy is important to treatment outcomes. In one embodiment, the invention provides cancer detection methods and agents for circulating tumor RNA, including for monitoring recurrence and/or development of common drug resistance mutations. In another embodiment, the invention provides detection methods and agents for detection and/or identification of bacterial species directly from blood or serum to monitor, e.g., disease progression and sepsis. In an embodiment of the invention, the Cas13b proteins and derivatives are used to distinguish and diagnose common diseases such as rhinovirus or upper respiratory tract infections from more serious infections such as bronchitis.

The invention provides methods and agents for rapid genotyping for emergency pharmacogenomics, including guidance for administration of anticoagulants during myocardial infarction or stroke treatment based on, e.g., VKORC1, CYP2C9, and CYP2C19 genotyping.

The invention provides agents and methods for monitoring food contamination by bacteria at all points along a food production and delivery chain. In another embodiment, the invention provides for quality control and monitoring, e.g. by identification of food sources and determination of purity. In one non-limiting example, the invention may be used to identify or confirm a food sources, such as a species of animal meat and seafood.

In another embodiment, the invention is used in Forensic determinations. For example, crime scene samples containing blood or other bodily fluids. In an embodiment of the invention, the invention is used to identify nucleic acid samples from fingerprints.

Use of RNA-Targeting Effector Protein in RNA Origami/In Vitro Assembly Lines—Combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can for instance be used to target proteins of interest to the RNA origami using a suitable guide RNA.

Use of RNA-Targeting Effector Protein in RNA Isolation or Purification, Enrichment or Depletion It is further envisages that the RNA targeting effector protein when complexed to RNA can be used to isolate and/or purify the RNA. The RNA targeting effector protein can for instance be fused to an affinity tag that can be used to isolate and/or purify the RNA-RNA targeting effector protein complex. Such applications are for instance useful in the analysis of gene expression profiles in cells. In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including but not limited to increasing stability, etc.), or alternatively to specifically deplete a particular RNA (such as without limitation for instance particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of an RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is for instance envisaged to probe the function of lincRNAs. Long intergenic non-coding RNAs (lincRNAs) are a vastly underexplored area of research. Most lincRNAs have as of yet unknown functions which could be studies using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. An RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are for instance facilitating substrate shuttling between proteins.

Synthetic Biology

The development of biological systems have a wide utility, including in clinical applications. It is envisaged that the programmable RNA targeting effector proteins of the invention can be used fused to split proteins of toxic domains for targeted cell death, for instance using cancer-linked RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flacking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bio-production (only produce product under certain conditions).

Inducible, Dosed and Self-Inactivating Systems

In one embodiment, fusion complexes comprising an RNA targeting effector protein of the invention and an effector component are designed to be inducible, for instance light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is for instance provided for by designing a fusion complex wherein FKBP/FRB (FK506 binding protein/FKBP rapamycin binding) pairing is used for fusion. Using this system rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as for instance an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying the own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using catalytically inactive Cas13b: enhancing translation (e.g. Cas13b-translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or Cas13b fused to or recruiting spliceosome components (e.g. U1 snRNA)); accessing RNA localization (e.g. Cas13b—marker fusions (e.g. EGFP fusions)); altering RNA localization (e.g. Cas13b—localization signal fusions (e.g. NLS or NES fusions)); RNA degradation (in this case no catalytically inactive Cas13b is to be used if relied on the activity of Cas13b, alternatively and for increased specificity, a split Cas13b may be used); inhibition of non-coding RNA function (e.g. miRNA), such as by degradation or binding of gRNA to functional sites (possibly titrating out at specific sites by relocalization by Cas13b-signal sequence fusions).

Cas13b function is robust to 5' or 3' extensions of the crRNA and to extension of the crRNA loop. It is therefore envisages that MS2 loops and other recruitment domains can be added to the crRNA without affecting complex formation and binding to target transcripts. Such modifications to the crRNA for recruitment of various effector domains are applicable in the uses of an RNA targeted effector proteins described above.

Cas13b is capable of mediating resistance to RNA phages. It is therefore envisaged that Cas13b can be used to immunize, e.g. animals, humans and plants, against RNA-only pathogens, including but not limited to retroviruses (e.g lentiviruses, such as HIV), HCV, Ebola virus and Zika virus.

In certain embodiments, Cas13b can process (cleave) its own array. This applies to both the wildtype Cas13b protein and the mutated Cas13b protein containing one or more mutated amino acid residues as herein-discussed. It is therefore envisaged that multiple crRNAs designed for different target transcripts and/or applications can be delivered as a single pre-crRNA or as a single transcript driven by one promotor. Such method of delivery has the advantages that it is substantially more compact, easier to synthesize and easier to delivery in viral systems. It will be understood that exact amino acid positions may vary for orthologues of a herein Cas13b can be adequately determined by protein alignment, as is known in the art, and as described herein elsewhere. Aspects of the invention also encompass methods and uses of the compositions and systems described herein in genome engineering, e.g. for altering or manipulating the expression of one or more genes or the one or more gene products, in prokaryotic or eukaryotic cells, in vitro, in vivo or ex vivo.

Aspects of the invention also encompass methods and uses of the compositions and systems described herein in genome or transcriptome engineering, e.g. for altering or manipulating the (protein) expression of one or more genes or the one or more gene products, in prokaryotic or eukaryotic cells, in vitro, in vivo or ex vivo.

In an aspect, the invention provides methods and compositions for modulating, e.g., reducing, (protein) expression of a target RNA in cells. In the subject methods, a Cas13b system of the invention is provided that interferes with transcription, stability, and/or translation of an RNA.

In certain embodiments, an effective amount of Cas13b system is used to cleave RNA or otherwise inhibit RNA expression. In this regard, the system has uses similar to siRNA and shRNA, thus can also be substituted for such methods. The method includes, without limitation, use of a Cas13b system as a substitute for e.g., an interfering ribonucleic acid (such as an siRNA or shRNA) or a transcription template thereof, e.g., a DNA encoding an shRNA. The Cas13b system is introduced into a target cell, e.g., by being administered to a mammal that includes the target cell, Advantageously, a Cas13b system of the invention is specific. For example, whereas interfering ribonucleic acid (such as an siRNA or shRNA) polynucleotide systems are plagued by design and stability issues and off-target binding, a Cas13b system of the invention can be designed with high specificity.

Destabilized Cas13b

In certain embodiments, the effector protein (CRISPR enzyme; Cas13b) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT. or CMP8 In some embodiments, the DD is DHFR50. A corresponding stabilizing ligand for this DD is, in some embodiments, TMP. As such, in some embodiments, one of the at least one DDs is DHFR50, and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme, and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme, and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N or C-term may enhance degradation; and such a tandem fusion can be, for example ER50-ER50-Cas13b or DHFR-DHFR-Cas13b It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the CRISPR enzyme comprises or consists essentially of or consists of a localization (nuclear import or export) signal as, or as part of, the linker between the CRISPR enzyme and the DD. HA or Flag tags are also within the ambit of the invention as linkers. Applicants use NLS and/or NES as linker and also use Glycine Serine linkers as short as GS up to $(GGGGS)_3$ (SEQ ID NO: 128).

Destabilizing domains have general utility to confer instability to a wide range of proteins; see, e.g., Miyazaki, J Am Chem Soc. Mar. 7, 2012; 134(9): 3942-3945, incorporated herein by reference. CMP8 or 4-hydroxytamoxifen can be destabilizing domains. More generally, A temperature-sensitive mutant of mammalian DHFR (DHFRts), a destabilizing residue by the N-end rule, was found to be stable at a permissive temperature but unstable at 37° C. The addition of methotrexate, a high-affinity ligand for mammalian DHFR, to cells expressing DHFRts inhibited degradation of the protein partially. This was an important demonstration that a small molecule ligand can stabilize a protein otherwise targeted for degradation in cells. A rapamycin derivative was used to stabilize an unstable mutant of the FRB domain of mTOR (FRB*) and restore the function of the fused kinase, GSK-3β.6,7 This system demonstrated that ligand-dependent stability represented an attractive strategy to regulate the function of a specific protein in a complex biological environment. A system to control protein activity can involve the DD becoming functional when the ubiquitin complementation occurs by rapamycin induced dimerization of FK506-binding protein and FKBP12. Mutants of human FKBP12 or ecDHFR protein can be engineered to be metabolically unstable in the absence of their high-affinity ligands, Shield-1 or trimethoprim (TMP), respectively. These mutants are some of the possible destabilizing domains (DDs) useful in the practice of the invention and instability of a DD as a fusion with a CRISPR enzyme confers to the CRISPR protein degradation of the entire fusion protein by the proteasome. Shield-1 and TMP bind to and stabilize the DD in a dose-dependent manner. The estrogen receptor ligand binding domain (ERLBD, residues 305-549 of ERS1) can also be engineered as a destabilizing domain. Since the estrogen receptor signaling pathway is involved in a variety of diseases such as breast cancer, the pathway has been widely studied and numerous agonist and antagonists of estrogen receptor have been developed. Thus, compatible pairs of ERLBD and drugs are known. There are ligands that bind to mutant but not wild-type forms of the ERLBD. By using one of these mutant domains encoding three mutations (L384M, M421G, G521R), it is possible to regulate the stability of an ERLBD-derived DD using a ligand that does not perturb endogenous estrogen-sensitive networks. An additional mutation (Y537S) can be introduced to further destabilize the ERLBD and to configure it as a potential DD candidate. This tetra-mutant is an advantageous DD development. The mutant ERLBD can be fused to a CRISPR enzyme, and its stability can be regulated or perturbed using a ligand, whereby the CRISPR enzyme has a DD. Another DD can be a 12-kDa (107-amino-acid) tag based on a mutated FKBP protein, stabilized by Shieldi ligand; see, e.g., Nature Methods 5, (2008). For instance, a DD can be a modified FK506 binding protein 12 (FKBP12) that binds to and is reversibly stabilized by a synthetic, biologically inert small molecule, Shield-1; see, e.g., Banaszynski L A, Chen L C, Maynard-Smith L A, Ooi A G, Wandless T J. A rapid, reversible, and tunable method to regulate protein function in living cells using synthetic small molecules. Cell. 2006; 126:995-1004; Banaszynski L A, Sellmyer M A, Contag C H, Wandless T J, Thorne S H. Chemical control of protein stability and function in living mice. Nat Med. 2008; 14:1123-1127; Maynard-Smith L A, Chen L C, Banaszynski L A, Ooi A G, Wandless T J. A directed approach for engineering conditional protein stability using biologically silent small molecules. The Journal of biological chemistry. 2007; 282:24866-24872; and Rodriguez, Chem Biol. Mar. 23, 2012; 19(3): 391-398-all of which are incorporated herein by reference and may be employed in the practice of the invention in selected a DD to associate with a CRISPR enzyme in the practice of this invention. As can be seen, the knowledge in the art includes a number of DDs, and the DD can be associated with, e.g., fused to, advantageously with a linker, to a CRISPR enzyme, whereby the DD can be stabilized in the presence of a ligand and when there is the absence thereof the DD can become destabilized, whereby the CRISPR enzyme is entirely destabilized, or the DD can be stabilized in the absence of a ligand and when the ligand is present the DD can become destabilized; the DD allows the CRISPR enzyme and hence the CRISPR-Cas complex or system to be regulated or controlled-turned on or off so to speak, to thereby provide means for regulation or control of the system, e.g., in an in vivo or in vitro environment. For instance, when a protein of interest is expressed as a fusion with the DD tag, it is destabilized and rapidly degraded in the cell, e.g., by proteasomes. Thus, absence of stabilizing ligand leads to a D associated Cas being degraded. When a new DD is fused to a protein of interest, its instability is conferred to the protein of interest, resulting in the rapid degradation of the entire fusion protein. Peak activity for Cas is sometimes beneficial to reduce off-target effects. Thus, short bursts of high activity are preferred. The present invention is able to provide such peaks. In some senses the system is inducible. In some other senses, the system repressed in the absence of stabilizing ligand and de-repressed in the presence of stabilizing ligand.

Application of RNA Targeting-CRISPR System to Plants and Yeast

Definitions

In general, the term "plant" relates to any various photosynthetic, eukaryotic, unicellular, or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, *eucalyptus*, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, *papaya*, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for modulating gene expression using the RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and CRISPR-Cas systems can be used over a broad range of plants, such as for example with dicotyledonous plants belonging to the orders Magnoliales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Fricales, Diapensales, Ebenales, Primulales, Rosales, Fabales, Podostemales, Hlaloragales, Myrtales, Cornales, Proteales, San tales, Rafflesiales, Celastrales, Euphorbiales, Rhamnales, Sapindales, Juglandales, Geraniales, Polygalales, LImbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Liliales, and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, Alseodaphne, Anacardiun, Arachis, Beilschmiedia, Brassica, Carthamuus, Cocculus, Croton, Cucunis, Citrus, Citrullus, Capsicum, Catharanthus, Cocos, Cogta, Cucurbita, Daucus, Duguectia, Eschscholzia, Ficus, Fragaria, Glaucium, Glycine, Gossypium, Heliantus, Hevea, Hyoscyanus, Lactuca, Landolphia, Linum, Litseai, Lycopersicon, Lupinus, Manihot, Majorana, Malus, Medicago, Nicotiana, Olea, Parthenuim, Papaver, Persea, Phaseolus, Pistacia, Pisun, Pyrus, Prunus, Raphamus, Ricinus, Senecio, Sinomenium, Stephania, Sinapis, Solanum, Theobroma, Trifolium, Trigonella, Vicia, Vinca, Vilis, and Vigna*; and the genera *Allium, Andropogon, Eragrostis, Asparagus, Avena, Cynodon, Elaeis, Festuca, Festulolium, Heterocallis, Hordeum, Lemna, Lolium, Musa, Oryza, Panicun, Pennisetum, Phleum, Poa, Secale, Sorghum, Triticum, Zea, Abies, Cunninghamia, Ephedra, Picea, Pinus,* and *Pseudotsuga*.

The RNA targeting CRISPR systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Ankistrodesmus, Botryococcus, Chaetoceros, Chlamydomonas, Chlorella, Chlorococcum, Cyclotella, Cylindrotheca, Dunaliella, Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porhyra, Pseudoanabaena, Pyramimonas, Stichococcus, Synechoccus, Synechocystis, Tetraselmis, Thalassiosira,* and *Trichodesmium*.

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendents of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus*, or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis*, a.k.a. *Pichia* kudriavzevii and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the Cas13b CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Stable Integration of RNA Targeting CRISPR System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to, a plastid, e mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, an RNA targeting CRISPR expression system comprises at least:
(a) a nucleotide sequence encoding a guide RNA (gRNA) that hybridizes with a target sequence in a plant, and wherein the guide RNA comprises a guide sequence and a direct repeat sequence, and
(b) a nucleotide sequence encoding an RNA targeting protein, wherein components (a) or (b) are located on the same or on different constructs, and whereby the different nucleotide sequences can be under control of the same or a different regulatory element operable in a plant cell.

DNA construct(s) containing the components of the RNA targeting CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom. In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1): 11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et al, Bio/Technology (1992), Casas et al, Proc. Natl. Acad. Sci. USA (1993).).

In particular embodiments, the DNA constructs containing components of the RNA targeting CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the Cas13b CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and as such also envisages regulating expression of plant biomolecules. In particular embodiments of the present invention, it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred, and inducible promoters. Different promoters may direct the expression of a gene in different tissues or cell types, or at different stages of development, or in response to different environmental conditions. In particular embodiments, one or more of the RNA targeting CRISPR components are expressed under the control of a constitutive promoter, such as the cauliflower mosaic virus 35S promoter, issue-preferred promoters can be utilized to target enhanced expression in certain cell types within a particular plant tissue, for instance vascular cells in leaves or roots or in specific cells of the seed. Examples of particular promoters for use in the RNA targeting CRISPR system are found in Kawamata et al., (1997) Plant Cell Physiol 38:792-803; Yamamoto et al., (1997) Plant J 12:255-65; Hire et al, (1992) Plant Mol Biol 20:207-18; Kuster et al., (1995) Plant Mol Biol 29:759-72; and Capana et al., (1994) Plant Mol Biol 25:681-91.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome), such as a Light Inducible Transcriptional Effector (LITE) that direct changes in transcriptional activity in a sequence-specific manner. The components of a light inducible system may include an RNA targeting CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize In2-2 promoter, activated by benzene sulfonamide herbicide safeners (De Veylder et al., (1997) Plant Cell Physiol 38:568-77), the maize GST promoter (GST-11-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose, use is made of chloroplast transformation methods or compartimentalization of the RNA targeting CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of RNA Targeting CRISPR System Components in Plants and Plant Cell In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is for instance a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants (see below). In particular embodiments, one or more of the RNA targeting components is prepared outside the plant or plant cell and delivered to the cell. For instance, in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified, and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology,* 2015; DOI: 10:1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as for instance described in WO 2008/042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO 2015/089419.

Further means of introducing one or more components of the RNA targeting CRISPR system to the plant cell is by using cell penetrating peptides (CPP). Accordingly, in particular, embodiments the invention comprises compositions comprising a cell penetrating peptide linked to an RNA targeting protein. In particular embodiments of the present invention, an RNA targeting protein and/or guide RNA(s) is coupled to one or more CPPs to effectively transport them inside plant protoplasts (Ramakrishna (2014, Genome Res. 2014 June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biolomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence; polyarginine peptide Args sequence, Guanine rich-molecular transporters, sweet arrow peptide, etc.

Target RNA Envisaged for Plant, Algae, or Fungal Applications

The target RNA, i.e. the RNA of interest, is the RNA to be targeted by the present invention leading to the recruitment to, and the binding of the RNA targeting protein at, the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments the target RNA may include interfering RNA (RNAi), microRNA (miRNA), microswitches, microenzymes, satellite RNAs and RNA viruses. The target RNA may be located in the cytoplasm of the plant cell, or in the cell nucleus or in a plant cell organelle such as a mitochondrion, chloroplast, or plastid.

In particular embodiments, the RNA targeting CRISPR system is used to cleave RNA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing or specifically targeting certain splice variants or isoforms; viral replication (in particular of plant viruses, including virioids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX).

Examples of modulating RNA expression in plants, algae, or fungi, as an alternative of targeted gene modification are described herein further.

Of particular interest is the regulated control of gene expression through regulated cleavage of mRNA. This can be achieved by placing elements of the RNA targeting under the control of regulated promoters as described herein.

Use of the RNA Targeting CRISPR System to Restore the Functionality of tRNA Molecules.

Pring et al. describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targetting mitochondrial and chloroplast mRNA can be introduced in a plant or plant cell to express different proteins in such plant cell organelles mimicking the processes occuring in vivo.

Use of the RNA Targeting CRISPR System as an Alternative to RNA Interference to Inhibit RNA Expression.

The RNA targeting CRISPR system has uses similar to RNA inhibition or RNA interference, thus can also be substituted for such methods. In particular embodiment, the methods of the present invention include the use of the RNA targeting CRISPR as a substitute for e.g. an interfering ribonucleic acid (such as an siRNA or shRNA or a dsRNA). Examples of inhibition of RNA expression in plants, algae, or fungi as an alternative of targeted gene modification are described herein further.

Use of the RNA Targeting CRISPR System to Control RNA Interference.

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth. In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor: 2.01). 01/2015; 120. DOI: 10.1016/j.pestbp.2015.01.002; Sharma et al. in Academic Journals (2015), Vol. 12(18) pp 2303-2312); Green J. M, in Pest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae, and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore, it appears that this element is an essential regulator of primary metabolism in plants (Bocobza and Aharoni, Plant J. 2014 August; 79(4):693-703. doi: 10.1111/tpj.12540. Epub 2014 June 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769). The RNA targeting CRISPR system described herein may be used to manipulate the endogenous riboswitch activity in plants, algae or fungi and as such alter the expression of downstream genes controlled by it. In particular embodiments, the RNA targeting CRISPR system may be used in assaying riboswitch function in vivo or in vitro and in studying its relevance for the metabolic network. In particular embodiments the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Cas13b protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization Further Applications of the RNA Targeting CRISPR System in Plants and Yeasts Use of RNA Targeting CRISPR System in Biofuel Production The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes why may interfere with the biofuel synthesis. More particularly the methods involve stimulating the expression in a micro-organism such as a yeast of one or more nucleotide sequence encoding enzymes involved in the conversion of pyruvate to ethanol or another product of interest. In particular embodiments the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) using Cas9. Using similar tools, the methods of the RNA targeting CRISPR system described herein can be applied on *Chlamydomonas* species and other algae. In particular embodiments, the RNA targeting effector protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a Cas13b system is used to engineer pathogen resistant plants, for example by creating resistance against diseases caused by bacteria, fungi or viruses. In certain embodiments, pathogen resistance can be accomplished by engineering crops to produce a Cas13b system that will be ingested by an insect pest, leading to mortality. In an embodiment of the invention, a Cas13b system is used to engineer abiotic stress tolerance. In another embodiment, a Cas13b system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a Cas13b system described herein. Some non-limiting target crops include *Oryza sativa* L, *Prunus domestica* L.., *Gossypium hirsutum, Nicotiana rustica, Zea mays, Medicago sativa, Nicotiana benthamiana* and *Arabidopsis thaliana.*

In an embodiment of the invention, a Cas13b system is used for management of crop pests. For example, a Cas13b system operable in a crop pest can be expressed from a plant host or transferred directly to the target, for example using a viral vector.

In an embodiment, the invention provides a method of efficiently producing homozygous organisms from a heterozygous non-human starting organism. In an embodiment, the invention is used in plant breeding. In another embodiment, the invention is used in animal breeding. In such embodiments, a homozygous organism such as a plant or animal is made by preventing or suppressing recombination by interfering with at least one target gene involved in double strand breaks, chromosome pairing and/or strand exchange.

Application of the Cas13b Proteins in Optimized Functional RNA Targeting Systems In an aspect, the invention provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc. Applications of this system are described elsewhere herein.

According to one aspect the invention provides non-naturally occurring or engineered composition comprising a guide RNA comprising a guide sequence capable of hybridizing to a target sequence in a genomic locus of interest in a cell, wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the Cas13b enzymes described herein are shown to be amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect the invention provides non-naturally occurring or engineered CRISPR-Cas13b complex composition comprising the guide RNA as herein-discussed and a Cas13b which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a Cas13b enzyme which has a diminished nuclease activity of at least 97%, or 100% as compared with the Cas13b enzyme not having the at least one mutation. In an aspect the invention provides a herein-discussed composition, wherein the Cas13b enzyme comprises two or more mutations as otherwise herein-discussed.

In particular embodiments, an RNA targeting system is provided as described herein above comprising two or more functional domains. In particular embodiments, the two or more functional domains are heterologous functional domain. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect the invention provides a herein-discussed composition, wherein the one or more functional domains associated with the adaptor protein or the RNA targeting enzyme is a domain capable of activating or repressing RNA translation. In an aspect the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect, the invention provides a herein-discussed composition comprising an aptamer sequence. In particular embodiments, the aptamer sequence is two or more aptamer sequences specific to the same adaptor protein. In an aspect the invention provides a herein-discussed composition, wherein the aptamer sequence is two or more aptamer sequences specific to different adaptor protein. In an aspect the invention provides a herein-discussed composition, wherein the adaptor protein comprises MS2, PP7, QP, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect, the invention provides a herein-discussed composition, wherein the cell is a eukaryotic cell. In an aspect, the invention provides a herein-discussed composition, wherein the eukaryotic cell is a mammalian cell, a plant cell or a yeast cell, whereby the mammalian cell is optionally a mouse cell. In an aspect, the invention provides a herein-discussed composition, wherein the mammalian cell is a human cell.

In an aspect, the invention provides a herein above-discussed composition wherein there is more than one gRNA, and the gRNAs target different sequences whereby when the composition is employed, there is multiplexing. In an aspect, the invention provides a composition wherein there is more than one gRNA modified by the insertion of distinct RNA sequence(s) that bind to one or more adaptor proteins.

In an aspect, the invention provides a herein-discussed composition wherein one or more adaptor proteins associated with one or more functional domains is present and bound to the distinct RNA sequence(s) inserted into the guide RNA(s).

In an aspect, the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect, the invention provides a method for modifying gene expression comprising the administration to a host or expression in a host in vivo of one or more of the compositions as herein-discussed.

In an aspect, the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect, the invention provides a herein-discussed method wherein the expression in vivo is via a lentivirus, an adenovirus, or an AAV.

In an aspect, the invention provides a mammalian cell line of cells as herein-discussed, wherein the cell line is, optionally, a human cell line or a mouse cell line. In an aspect, the invention provides a transgenic mammalian model, optionally a mouse, wherein the model has been transformed with a herein-discussed composition or is a progeny of said transformant.

In an aspect, the invention provides a nucleic acid molecule(s) encoding guide RNA or the RNA targeting CRISPR-Cas complex or the composition as herein-discussed. In an aspect, the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect, the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect, a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect, the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect, the invention provides a library of non-naturally occurring or engineered compositions, each comprising an RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide RNAs (gRNAs). In an aspect, the invention provides a library as herein-discussed, wherein the RNA targeting RNA targeting enzyme has a diminished nuclease activity of at least 97%, or 100% as compare with the RNA targeting enzyme not having the at least one mutation. In an aspect, the invention provides a library as herein-discussed, wherein the adaptor protein is a fusion protein comprising the functional domain. In an aspect, the invention provides a library as herein discussed, wherein the gRNA is not modified by the insertion of distinct RNA sequence(s) that bind to the one or two or more adaptor proteins. In an aspect, the invention provides a library as herein discussed, wherein the one or two or more functional domains are associated with the RNA targeting enzyme. In an aspect, the invention provides a library as herein discussed, wherein the cell population of cells is a population of eukaryotic cells. In an aspect, the invention provides a library as herein discussed, wherein the eukaryotic cell is a mammalian cell, a plant cell or a yeast cell. In an aspect, the invention provides a library as herein discussed, wherein the mammalian cell is a human cell. In an aspect, the invention provides a library as herein discussed, wherein the population of cells is a population of embryonic stem (ES) cells.

In an aspect, the invention provides a library as herein discussed, wherein the targeting is of about 100 or more RNA sequences. In an aspect, the invention provides a library as herein discussed, wherein the targeting is of about 1000 or more RNA sequences. In an aspect, the invention provides a library as herein discussed, wherein the targeting is of about 20,000 or more sequences. In an aspect, the invention provides a library as herein discussed, wherein the targeting is of the entire transcriptome. In an aspect, the invention provides a library as herein discussed, wherein the targeting is of a panel of target sequences focused on a relevant or desirable pathway. In an aspect, the invention provides a library as herein discussed, wherein the pathway is an immune pathway. In an aspect, the invention provides a library as herein discussed, wherein the pathway is a cell division pathway.

In one aspect, the invention provides a method of generating a model eukaryotic cell comprising a gene with modified expression. In some embodiments, a disease gene is any gene associated an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the genomic level.

The skilled person will understand that modifications to the guide RNA which allow for binding of the adapter+ functional domain but not proper positioning of the adapter+ functional domain (e.g. due to steric hindrance within the three dimensial structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more genomic events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR RNA targeting events. (See, e.g., Platt et al., Cell (2014), dx.doi.org/10.1016/j.cell.2014.09.014, or PCT patent publications cited herein, such as WO 2014/093622 (PCT/US2013/074667), which are not believed prior to the present invention or application). For example, the target cell comprises RNA targeting CRISPR enzyme conditionally or inducibly (e.g. in the form of Cre dependent constructs) and/or the adapter protein conditionally or inducibly and, on expression of a vector introduced into the target cell, the vector expresses that which induces or gives rise to the condition of s RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible s RNA targeting enzyme to provide an effective model for screening purposes, which advantageously only requires minimal design and administration of specific gRNAs for a broad number of applications.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity/without indel activity). For matters of explanation such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional RNA targeting as described herein, and guide RNA (gRNA) wherein the gRNA comprises a dead guide sequence whereby the gRNA is capable of hybridizing to a target sequence such that the RNA targeting CRISPR-Cas system is directed to a genomic locus of interest in a cell without detectable RNA cleavage activity of a non-mutant RNA targeting enzyme of the system. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within a genome of a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing Cas13b specific equivalents. Structural similarity between, e.g., the orthologous nuclease domains HEPN of two or more Cas13b effector proteins may be used to transfer design equivalent dead guides. Thus, the dead guide herein may be appropriately modified in length and sequence to reflect such Cas13b specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell, in the same animal, or in the same patient. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

General Provisions

In an aspect, the invention provides a nucleic acid binding system. In situ hybridization of RNA with complementary probes is a powerful technique. Typically, fluorescent DNA oligonucleotides are used to detect nucleic acids by hybridization. Increased efficiency has been attained by certain modifications, such as locked nucleic acids (LNAs), but there remains a need for efficient and versatile alternatives. The invention provides an efficient and adaptable system for in situ hybridization.

In embodiments of the invention the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

As used herein, the term "crRNA" or "guide RNA" or "single guide RNA" or "sgRNA" or "one or more nucleic acid components" of a Type V or Type VI CRISPR-Cas locus effector protein comprises any polynucleotide sequence having sufficient complementarity with a target nucleic acid sequence to hybridize with the target nucleic acid sequence and direct sequence-specific binding of a nucleic acid-targeting complex to the target nucleic acid sequence.

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such at at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

For minimization of toxicity and off-target effects, it will be important to control the concentration of RNA-targeting guide RNA delivered. Optimal concentrations of nucleic acid-targeting guide RNA can be determined by testing different concentrations in a cellular or non-human eukaryote animal model and using deep sequencing the analyze the extent of modification at potential off-target genomic loci. The concentration that gives the highest level of on-target modification while minimizing the level of off-target modification should be chosen for in vivo delivery. The RNA-targeting system is derived advantageously from a CRISPR-Cas13b system. In some embodiments, one or more elements of an RNA-targeting system is derived from a particular organism comprising an endogenous RNA-targeting system of a Cas13b effector protein system as herein-discussed.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. In particular embodiments, the homologue or orthologue of a Cas13b protein as referred to herein has a sequence homology or identity of at least 50%, at least 60%, at least 70%, at least 80%, more preferably at least 85%, even more preferably at least 90%, such as for instance at least 95% with a Cas13b effector protein set forth in FIG. 1.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to Bergeyella, Prevotella, Porphyromonas, Bacteroides, Alistipes, Riemerella, Myroides, Flavobacterium, Capnocytophaga, Chryseobacterium, Phaeodactylibacter, Paludibacter or Psychroflexus. A chimeric enzyme can comprise a first fragment and a second fragment, and the fragments, wherein one of the first and second fragment is of or from a Cas13b effector protein of a first species (for example, a Cas13b effector protein as listed in FIG. 1) and the other fragment is of or from a CRISPR enzyme ortholog of a different species.

In an embodiment of the invention, there is provided an effector protein which comprises an amino acid sequence which is at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of Porphyromonas gulae Cas13b (accession number WP_039434803), Prevotella sp. P5-125 Cas13b (accession number WP_044065294), Porphyromonas gingivalis Cas13b (accession number WP_053444417), Porphyromonas sp. COT-052 OH4946 Cas13b (accession number WP_039428968), Bacteroides pyogenes Cas13b (accession number WP_034542281), Riemerella anatipestifer Cas13b (accession number WP_004919755). The most preferred effector proteins are those at least 50%, 60%, 70%, 80%, 85%, 90%, 91%, 92%, 93%, 94%, 95%, 96%, 97%, 98%, 99% or more homologous or identical to a wild type Cas13b effector protein selected from the group consisting of Porphyromonas gulae Cas13b (accession number WP_039434803), Prevotella sp. P5-125 Cas13b (accession number WP_044065294), Porphyromonas gingivalis Cas13b (accession number WP_053444417), Porphyromonas sp. COT-052 OH4946 Cas13b (accession number WP_039428968); and most specifically preferred are Porphyromonas gulae Cas13b (accession number WP_039434803) or Prevotella sp. P5-125 Cas13b (accession number WP_044065294).

It has been found that a number of Cas13b orthologs are characterized by common motifs. Accordingly, in particular embodiments, the Cas13b effector protein is a protein comprising a sequence having at least 70% sequence identity with one or more of the sequences consisting of DKHXFGAFLNLARHN (SEQ ID NO: 118), GLLFFVSLFLDK (SEQ ID NO: 119), SKIXGFK (SEQ ID NO: 120), DMLNELXRCP (SEQ ID NO: 121), RXZDRFPYFALRYXD (SEQ ID NO: 122) and LRFQVBLGXY (SEQ ID NO: 123). In further particular embodiments, the Cas13b effector protein comprises a sequence having at least 70% sequence identity at least 2, 3, 4, 5 or all 6 of these sequences. In further particular embodiments, the sequence identity with these sequences is at least 75%, 80%, 85%, 90%, 95% or 100%. In further particular embodiments, the Cas13b effector protein is a protein comprising a sequence having 100% sequence identity with GLLFFVSLFL (SEQ ID NO: 124) and RHQXRFPYF (SEQ ID NO: 125). In further particular embodiments, the Cas13b effector is a Cas13b effector protein comprising a sequence having 100% sequence identity with RHQDRFPY (SEQ ID NO: 126).

In an embodiment of the invention, the effector protein comprises an amino acid sequence having at least 80% 85%, 90%, 91%, 92%, 93%, 94%, 95%, 96%, 97%, 98%, 99% or more sequence homology or identity to a Type VI-B effector protein consensus sequence including but not limited to a consensus sequence described herein.

In an embodiment of the invention, the effector protein comprises at least one HEPN domain, including but not limited to HEPN domains described herein, HEPN domains known in the art, and domains recognized to be HEPN domains by comparison to consensus sequences and motifs. In one non-limiting example, a consensus sequence can be derived from the sequences of Cas13b orthologs provided herein.

In an embodiment of the invention, the effector protein comprises one or more HEPN domains comprising a RxxxxH motif sequence. The RxxxxH motif sequence can be, without limitation, from an HEPN domain described herein or an HEPN domain known in the art. RxxxxH motifs sequences further include motif sequences created by combining portions of two or more HEPN domains.

In some embodiments, the effector protein comprises two HEPN domains. In some embodiments, the effector protein comprises at least one catalytically active HEPN domain comprising an RxxxxH motif. In some embodiments, the effector protein comprises two catalytically active HEPN domains each comprising an RxxxxH motif. In some embodiments, the effector protein comprises at least one catalytically inactive HEPN domain obtained from mutating at least one of R or H of a wild-type RxxxxH motif In some embodiments, the effector protein comprises two catalytically inactive HEPN domains each obtained from mutating at least one of R or H of a wild-type RxxxxH motif.

In an embodiment, nucleic acid molecule(s) encoding the Type VI-B RNA-targeting effector protein may be codon-optimized for expression in an eukaryotic cell. A eukaryote can be as herein discussed. Nucleic acid molecule(s) can be engineered or non-naturally occurring.

In an embodiment, the Type VI-B RNA-targeting effector protein, in particular Cas13b or an ortholog or homolog thereof, may comprise one or more mutations (and hence nucleic acid molecule(s) coding for same may have mutation(s)). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains. Examples of catalytic domains with reference to a Cas13b enzyme may include but are not limited to HEPN domains.

In an embodiment, the Type VI-B protein such as Cas13b or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the Type VI-B protein such as Cas13b or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In some embodiments, the unmodified nucleic acid-targeting effector protein may have cleavage activity. In some embodiments, the RNA-targeting effector protein may direct cleavage of one or both nucleic acid (DNA or RNA) strands at the location of or near a target sequence, such as within the target sequence and/or within the complement of the target sequence or at sequences associated with the target sequence. In some embodiments, the nucleic acid-targeting Cas protein may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a nucleic acid-targeting Cas protein that may be mutated with respect to a corresponding wild-type enzyme such that the mutated nucleic acid-targeting Cas protein lacks the ability to cleave RNA strands of a target polynucleotide containing a target sequence. As a further example, two or more catalytic domains of Cas (e.g. HEPN domain) may be mutated to produce a mutated Cas substantially lacking all RNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type VI-B CRISPR system. By derived, Applicants mean that the derived enzyme is largely based on, in the sense of having a high degree of sequence homology with, a wildtype enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector protein from the Type VI CRISPR locus. However, it will be appreciated that this invention includes many more effector proteins from other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector protein or has cells containing nucleic acid-targeting effector protein, such as by way of prior administration thereto of a vector or vectors that code for and express in vivo nucleic acid-targeting effector protein. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations, and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a nucleic acid-targeting effector protein. nucleic acid-targeting effector protein or nucleic acid-targeting guide RNA or RNA(s) can be delivered separately; and advantageously at least one of these is delivered via a particle or nanoparticle complex. nucleic acid-targeting effector protein mRNA can be delivered prior to the nucleic acid-targeting guide RNA to give time for nucleic acid-targeting effector protein to be expressed. nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+guide RNA. Additional administrations of nucleic acid-targeting effector protein mRNA and/or guide RNA might be useful to achieve the most efficient levels of genome and/or transcriptome modification.

In one aspect, the invention provides methods for using one or more elements of a nucleic acid-targeting system. The nucleic acid-targeting complex of the invention provides an effective means for modifying a target RNA. The nucleic acid-targeting complex of the invention has a wide variety of utility including modifying (e.g., deleting, inserting, translocating, inactivating, activating) a target RNA in a multiplicity of cell types. As such the nucleic acid-targeting complex of the invention has a broad spectrum of applications in, e.g., gene therapy, drug screening, disease diagnosis, and prognosis. An exemplary nucleic acid-targeting complex comprises an RNA-targeting effector protein complexed with a guide RNA hybridized to a target sequence within the target locus of interest.

In one embodiment, this invention provides a method of cleaving a target RNA. The method may comprise modifying a target RNA using a nucleic acid-targeting complex that binds to the target RNA and effect cleavage of said target RNA. In an embodiment, the nucleic acid-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is an RNA sequence that shares sequence similarity with the RNA sequence upstream of the targeted site for integration. Similarly, the downstream sequence is an RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., double or single stranded break in double or single stranded DNA or RNA) is introduced into the DNA or RNA sequence by the nucleic acid-targeting complex, the break is repaired via homologous recombination with an exogenous RNA template such that the template is integrated into the RNA target. The presence of a double-stranded break facilitates integration of the template. In other embodiments, this invention provides a method of modifying expression of an RNA in a eukaryotic cell. The method comprises increasing or decreasing expression of a target polynucleotide by using a nucleic acid-targeting complex that binds to the RNA (e.g., mRNA or pre-mRNA). In some methods, a target RNA can be inactivated to affect the modification of the expression in a cell. For example, upon the binding of an RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of an RNA-targeting complex can be any RNA endogenous or exogenous to the eukaryotic cell. For example, the target RNA can be an RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissues compared with tissues or cells of a non disease control. It may be an RNA transcribed from a gene that becomes expressed at an abnormally high level; it may be an RNA transcribed from a gene that becomes expressed at an abnormally low level, where the altered expression correlates with the occurrence and/or progression of the disease. A disease-associated RNA also refers to an RNA transcribed from a gene possessing mutation(s) or genetic variation that is directly responsible or is in linkage disequilibrium with a gene(s) that is responsible for the etiology of a disease. The translated products may be known or unknown and may be at a normal or abnormal level. The target RNA of an RNA-targeting complex can be any RNA endogenous or exogenous to the eukaryotic cell. For example, the target RNA can be an RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a nucleic acid-targeting complex to bind to the target RNA to effect cleavage of said target RNA or RNA thereby modifying the target RNA, wherein the nucleic acid-targeting complex comprises a nucleic acid-targeting effector protein complexed with a guide RNA hybridized to a target sequence within said target RNA. In one aspect, the invention provides a method of modifying expression of RNA in a eukaryotic cell. In some embodiments, the method comprises allowing a nucleic acid-targeting complex to bind to the RNA such that said binding results in increased or decreased expression of said RNA; wherein the nucleic acid-targeting complex comprises a nucleic acid-targeting effector protein complexed with a guide RNA. Similar considerations and conditions apply as above for methods of modifying a target RNA. In fact, these sampling, culturing, and re-introduction options apply across the aspects of the present invention. In one aspect, the invention provides for methods of modifying a target RNA in a eukaryotic cell, which may be in vivo, ex vivo or in vitro. In some embodiments, the method comprises sampling a cell or population of cells from a human or non-human animal and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the nucleic acid-targeting complex may comprise a nucleic acid-targeting effector protein complexed with a guide RNA hybridized to a target sequence.

The invention relates to the engineering and optimization of systems, methods and compositions used for the control of gene expression involving RNA sequence targeting, that relate to the nucleic acid-targeting system and components thereof. In advantageous embodiments, the effector protein is a Type VI-B protein such as Cas13b. An advantage of the present methods is that the CRISPR system minimizes or avoids off-target binding and its resulting side effects. This is achieved using systems arranged to have a high degree of sequence specificity for the target RNA.

The use of two different aptamers (each associated with a distinct nucleic acid-targeting guide RNAs) allows an activator-adaptor protein fusion and a repressor-adaptor protein fusion to be used, with different nucleic acid-targeting guide RNAs, to activate expression of one DNA or RNA, whilst repressing another. They, along with their different guide RNAs can be administered together, or substantially together, in a multiplexed approach. A large number of such modified nucleic acid-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number of modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the nucleic acid-targeting effector protein-guide RNA complex as a whole may be associated with two or more functional domains. For example, there may be two or more functional domains associated with the nucleic acid-targeting effector protein, or there may be two or more functional domains associated with the guide RNA (via one or more adaptor proteins), or there may be one or more functional domains associated with the nucleic acid-targeting effector protein and one or more functional domains associated with the guide RNA (via one or more adaptor proteins).

The fusion between the adaptor protein and the activator or repressor may include a linker. For example, GlySer linkers GGGS (SEQ ID NO: 127) can be used. They can be used in repeats of 3 ((GGGGS)$_3$) (SEQ ID NO: 128) or 6 (SEQ ID NO: 129), 9 (SEQ ID NO: 130) or even 12 (SEQ ID NO: 131) or more, to provide suitable lengths, as required. Linkers can be used between the guide RNAs and the functional domain (activator or repressor), or between the nucleic acid-targeting effector protein and the functional domain (activator or repressor). The linkers the user to engineer appropriate amounts of "mechanical flexibility".

The invention comprehends a nucleic acid-targeting complex comprising a nucleic acid-targeting effector protein and a guide RNA, wherein the nucleic acid-targeting effector protein comprises at least one mutation, such that the nucleic acid-targeting Cas protein has no more than 5% of the activity of the nucleic acid-targeting Cas protein not having the at least one mutation and, optionally, at least one or more nuclear localization sequences; the guide RNA comprises a guide sequence capable of hybridizing to a target sequence in an RNA of interest in a cell; and wherein: the nucleic acid-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the nucleic acid-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

Cas13b Effector Protein Complexes can Deliver Functional Effectors

Unlike CRISPR-Cas13b-mediated knockout, which eliminates expression by mutating at the RNA level, CRISPR-Cas13b knockdown allows for temporary reduction of gene expression through the use of artificial transcription factors, e.g., via mutating residues in cleavage domain(s) of the Cas13b protein results in the generation of a catalytically inactive Cas13b protein. A catalytically inactive Cas13b complexes with a guide RNA or crRNA and localizes to the RNA sequence specified by that guide RNA's or crRNA's targeting domain, however, it does not cleave the target. Fusion of the inactive Cas13b protein to an effector domain, e.g., a transcription repression domain, enables recruitment of the effector to any site specified by the guide RNA.

Optimized Functional RNA Targeting Systems

In an aspect the invention thus provides a system for specific delivery of functional components to the RNA environment. This can be ensured using the CRISPR systems comprising the RNA targeting effector proteins of the present invention which allow specific targeting of different components to RNA. More particularly such components include activators or repressors, such as activators or repressors of RNA translation, degradation, etc.

According to one aspect the invention provides non-naturally occurring or engineered composition comprising a guide RNA or crRNA comprising a guide sequence capable of hybridizing to a target sequence of interest in a cell, wherein the guide RNA or crRNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. When there is more than one functional domain, the functional domains can be same or different, e.g., two of the same or two different activators or repressors. In an aspect the invention provides a herein-discussed composition, wherein the one or more functional domains are attached to the RNA targeting enzyme so that upon binding to the target RNA the functional domain is in a spatial orientation allowing for the functional domain to function in its attributed function; In an aspect the invention provides a herein-discussed composition, wherein the composition comprises a CRISPR-Cas13b complex having at least three functional domains, at least one of which is associated with the RNA targeting enzyme and at least two of which are associated with the gRNA or crRNA.

Delivery of the Cas13b Effector Protein Complex or Components Thereof

Through this disclosure and the knowledge in the art, TALEs, CRISPR-Cas systems, or components thereof or nucleic acid molecules thereof (including, for instance HDR template) or nucleic acid molecules encoding or providing components thereof may be delivered by a delivery system herein described both generally and in detail.

Vector delivery, e.g., plasmid, viral delivery: The CRISPR enzyme, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenyl-ethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein, the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^8$-$1 \times 10^{12}$ particles), and most preferably at least about $1 \times 10^0$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about $4 \times 10^6$ pu, about $1 \times 10^7$ pu, about $2 \times 10^7$ pu, about $4 \times 10^7$ pu, about $1 \times 10^8$ pu, about $2 \times 10^8$ pu, about $4 \times 10^8$ pu, about $1 \times 10^9$ pu, about $2 \times 10^9$ pu, about $4 \times 10^9$ pu, about $1 \times 10^{10}$ pu, about $2 \times 10^{10}$ pu, about $4 \times 10^{10}$ pu, about $1 \times 10^{11}$ pu, about $2 \times 10^{11}$ pu, about $4 \times 10^{11}$ pu, about $1 \times 10^{12}$ pu, about $2 \times 10^{12}$ pu, or about $4 \times 10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1 \times 10^{10}$ to about $1 \times 10^{10}$ functional AAV/ml solution. The dosage may be adjusted to balance the therapeutic benefit against any side effects. In an embodiment herein, the AAV dose is generally in the range of concentrations of from about $1 \times 10^5$ to $1 \times 10^{50}$ genomes AAV, from about $1 \times 10^8$ to $1 \times 10^{20}$ genomes AAV, from about $1 \times 10^{10}$ to about 1×10$^{16}$ genomes, or about 1×10$^{11}$ to about 1×10$^{16}$ genomes AAV. A human dosage may be about 1×10$^{13}$ genomes AAV. Such concentrations may be delivered in from about 0.001 ml to about 100 ml, or about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg per 70 kg individual. Plasmids of the invention will generally comprise (i) a promoter; (ii) a sequence encoding an nucleic acid-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660) which may also be applied to the present invention.

Indeed, RNA delivery is a useful method of in vivo delivery. It is possible to deliver nucleic acid-targeting Cas protein and guide RNA (and, for instance, HR repair template) into cells using liposomes or particles. Thus, delivery of the nucleic acid-targeting Cas13b protein and/or delivery of the guide RNAs or crRNAs of the invention may be in RNA form and via microvesicles, liposomes or particles. For example, Cas13b mRNA and guide RNA or crRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (α-tocopherol) may be conjugated with nucleic acid-targeting Cas protein and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, Calif.) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of nucleic acid-targeting effector protein conjugated to α-tocopherol and co-administered with HDL targeted to the brain may be contemplated for humans in the present invention, for example, about 3 nmol to about 3 μmol of nucleic acid-targeting effector protein targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 μl of a recombinant lentivirus having a titer of 1×10$^9$ transducing units (TU)/ml by an intrathecal catheter. A similar dosage of nucleic acid-targeting effector protein expressed in a lentiviral vector targeted to the brain may be contemplated for humans in the present invention, for example, about 10-50 ml of nucleic acid-targeting effector protein targeted to the brain in a lentivirus having a titer of 1×10$^9$ transducing units (TU)/ml may be contemplated.

In terms of local delivery to the brain, this can be achieved in various ways. For instance, material can be delivered intrastriatally e.g., by injection. Injection can be performed stereotactically via a craniotomy.

Packaging and Promoters Generally

Ways to package RNA-targeting effector protein (Cas13b proteins) coding nucleic acid molecules, e.g., DNA, into vectors, e.g., viral vectors, to mediate genome modification in vivo include:

Single virus vector:

Vector containing two or more expression cassettes:

Promoter-nucleic acid-targeting effector protein coding nucleic acid molecule-terminator Promoter-guide RNA1-terminator Promoter-guide RNA (N)-terminator (up to size limit of vector)

Double virus vector:
Vector 1 containing one expression cassette for driving the expression of RNA-targeting effector protein (Cas13b)
Promoter-RNA-targeting effector (Cas13b) protein coding nucleic acid molecule-terminator
Vector 2 containing one more expression cassettes for driving the expression of one or more guideRNAs or crRNAs
Promoter-guide RNA1 or crRNA1-terminator
Promoter-guide RNA1 (N) or crRNA1 (N)-terminator (up to size limit of vector).

The promoter used to drive RNA-targeting effector protein coding nucleic acid molecule expression can include AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of nucleic acid-targeting effector protein. For ubiquitous expression, can use promoters: CMV, CAG, CBh, PGK, SV40, Ferritin heavy or light chains, etc. For brain or other CNS expression, can use promoters: SynapsinI for all neurons, CaMKIIalpha for excitatory neurons, GAD67 or GAD65 or VGAT for GABAergic neurons, etc. For liver expression, can use Albumin promoter. For lung expression, can use SP-B. For endothelial cells, can use ICAM. For hematopoietic cells, can use IFNbeta or CD45. For Osteoblasts, can use OG-2. The promoter used to drive guide RNA can include: Pol III promoters such as U6 or H1; Pol II promoter and intronic cassettes to express guide RNA or crRNA.

Adeno Associated Virus (AAV)

Cas13b and one or more guide RNA or crRNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g., a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of RNA-targeting effector protein (Cas13b effector protein) can be driven by a cell-type specific promoter. For example, liver-specific expression might use the Albumin promoter and neuron-specific expression (e.g., for targeting CNS disorders) might use the Synapsin I promoter. In terms of in vivo delivery, AAV is advantageous over other viral vectors for a couple of reasons: Low toxicity (this may be due to the purification method not requiring ultra centrifugation of cell particles that can activate the immune response) and Low probability of causing insertional mutagenesis because it does not integrate into the host genome.

AAV has a packaging limit of 4.5 or 4.75 Kb. This means that the RNA-targeting effector protein (Cas13b effector protein) coding sequence as well as a promoter and transcription terminator have to be all fit into the same viral vector. As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types. Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 µg of lentiviral transfer plasmid (pCasES10) and the following packaging plasmids: 5 µg of pMD2.G (VSV-g pseudotype), and 7.5 µg of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the nucleic acid-targeting system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the nucleic acid-targeting system of the present invention. A minimum of $2.5 \times 10^6$ CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm$^2$ tissue culture flasks coated with fibronectin (25 mg/cm$^2$) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

RNA Delivery

RNA delivery: The nucleic acid-targeting Cas13b protein, and/or guide RNA, can also be delivered in the form of RNA. mRNA can be synthesized using a PCR cassette containing the following elements: T7_promoter-kozak sequence (GCCACC (SEQ ID NO: 634))-effector protein-3' UTR from beta globin-polyA tail (a string of 120 or more adenines). The cassette can be used for transcription by T7 polymerase. Guide RNAs or crRNAs can also be transcribed using in vitro transcription from a cassette containing T7_promoter-GG-guide RNA or crRNA sequence.

Particle Delivery Systems and/or Formulations:

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (µm). In some embodiments, inventive particles have a greatest dimension of less than 10 µm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas13b system e.g., Cas13b enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof. See also Dahlman et al. "Orthogonal gene control with a catalytically active Cas9 nuclease," Nature Biotechnology 33, 1159-1161 (November, 2015).

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

Particles

Cas13b mRNA and guide RNA or crRNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes). Cas13b effector protein mRNA and guide RNA may be delivered simultaneously using particles or lipid envelopes. This Dahlman et al. technology can be applied in the instant invention. An epoxide-modified lipid-polymer may be utilized to deliver the nucleic acid-targeting system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg. For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles based on self-assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

Regarding particles, see, also Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the nucleic acid-targeting system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition. US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell. US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the nucleic acid-targeting system of the present invention.

In another embodiment, lipid nanoparticles (LNPs) are contemplated. An antitransthyretin small interfering RNA has been encapsulated in lipid nanoparticles and delivered to humans (see, e.g., Coelho et al., N Engl J Med 2013; 369:819-29), and such a system may be adapted and applied to the nucleic acid-targeting system of the present invention. Doses of about 0.01 to about 1 mg per kg of body weight administered intravenously are contemplated. Medications to reduce the risk of infusion-related reactions are contemplated, such as dexamethasone, acetaminophen, diphenhydramine or cetirizine, and ranitidine are contemplated. Multiple doses of about 0.3 mg per kilogram every 4 weeks for five doses are also contemplated. LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding nucleic acid-targeting effector protein to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease. However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 µg/ml of LNP or CRISPR-Cas RNA in or associated with the LNP may be contemplated, especially for a formulation containing DLinKC2-DMA.

Preparation of LNPs and CRISPR-Cas13b encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(o-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, Mo.). The specific nucleic acid-targeting complex (CRISPR-Cas) RNA may be encapsulated in LNPs containing DLinDAP, DLinDMA, DLinK-DMA, and DLinKC2-DMA (cationic lipid:DSPC:CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC: cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Particle size distribution may be determined by dynamic light scattering using a NICOMP 370 particle sizer, the vesicle/intensity modes, and Gaussian fitting (Nicomp Particle Sizing, Santa Barbara, Calif.). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted particles and quantified at 260 nm. RNA to lipid ratio was determined by measurement of cholesterol content in vesicles using the Cholesterol E enzymatic assay from Wako Chemicals USA (Richmond, Va.). In conjunction with the herein discussion of LNPs and PEG lipids, PEGylated liposomes or LNPs are likewise suitable for delivery of a nucleic acid-targeting system or components thereof. Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other particles (particularly gold particles) are also contemplated as a means to delivery nucleic acid-targeting system to intended targets. Significant data show that AuraSense Therapeutics' Spherical Nucleic Acid (SNA™) constructs, based upon nucleic acid-functionalized gold particles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling particles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of nucleic acid-targeting complex RNA is envisioned for delivery in the self-assembling particles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclodo-decane-1,4,7,10-tetraacetic acid mono(N-hydroxysuccinimide ester) (DOTA-NHSester) was ordered from Macrocyclics (Dallas, Tex.). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, Calif.) to remove trace metal contaminants. Tf-targeted and nontargeted siRNA particles may be formed by using cyclodextrin-containing polycations. Typically, particles were formed in water at a charge ratio of 3 (+/−) and an siRNA concentration of 0.5 g/liter. One percent of the adamantane-PEG molecules on the surface of the targeted particles were modified with Tf (adamantane-PEG-Tf). The particles were suspended in a 5% (wt/vol) glucose carrier solution for injection.

Davis et al. (Nature, Vol 464, 15 Apr. 2010) conducts an RNA clinical trial that uses a targeted particle-delivery system (clinical trial registration number NCT00689065). Patients with solid cancers refractory to standard-of-care therapies are administered doses of targeted particles on days 1, 3, 8 and 10 of a 21-day cycle by a 30-min intravenous infusion. The particles comprise, consist essentially of, or consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These particles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^2$ siRNA, respectively. Similar doses may also be contemplated for the nucleic acid-targeting system of the present invention. The delivery of the invention may be achieved with particles containing a linear, cyclodextrin-based polymer (CDP), a human transferrin protein (TF) targeting ligand displayed on the exterior of the particle to engage TF receptors (TFR) on the surface of the cancer cells and/or a hydrophilic polymer (for example, polyethylene glycol (PEG) used to promote particle stability in biological fluids).

In terms of this invention, it is preferred to have one or more components of RNA-targeting complex, e.g., nucleic acid-targeting effector (Cas13b) protein or mRNA therefor, or guide RNA or crRNA delivered using particles or lipid envelopes. Other delivery systems or vectors are may be used in conjunction with the particle aspects of the invention. Particles encompassed in the present invention may be provided in different forms, e.g., as solid particles (e.g., metal such as silver, gold, iron, titanium), non-metal, lipid-based solids, polymers), suspensions of particles, or combinations thereof. Metal, dielectric, and semiconductor particles may be prepared, as well as hybrid structures (e.g., core-shell particles). Particles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft particles have been manufactured, and are within the scope of the present invention. A prototype particle of semi-solid nature is the liposome. Various types of liposome particles are currently used clinically as delivery systems for anticancer drugs and vaccines. Particles with one half hydrophilic and the other half hydrophobic are termed Janus particles and are particularly effective for stabilizing emulsions. They can self-assemble at water/oil interfaces and act as solid surfactants.

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm$^3$ with a mean diameter of between 5 μm and 30 μm, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can be envisioned that such methods and materials of herein-cited documents, e.g., conjugated lipomers can be used in the context of the nucleic acid-targeting system to achieve in vitro, ex vivo and in vivo genomic perturbations to modify gene expression, including modulation of protein expression. Exosomes Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MIC) haplotype. As immature dendritic cells produce large quantities of exosomes devoid of T-cell activators such as NMC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by particle tracking analysis (NTA) and electron microscopy. Alvarez-Erviti et al. obtained 6-12 pg of exosomes (measured based on protein concentration) per $10^6$ cells. Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 pF resulted in the greatest retention of RNA and was used for all subsequent experiments. Alvarez-Erviti et al. administered 150 pg of each BACE1 siRNA encapsulated in 150 pg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or –] 15%, P<0.001 and 61% [+ or –] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA. Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the nucleic acid-targeting system of the present invention to therapeutic targets, especially neurodegenerative diseases. A dosage of about 100 to 1000 mg of nucleic acid-targeting system encapsulated in about 100 to 1000 mg of RVG exosomes may be contemplated for the present invention.

El-Andaloussi et al. (Nature Protocols 7,2112-2126 (2012)) provides exosomes derived from cultured cells harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention. Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Qiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of nucleic acid-targeting system into exosomes may be conducted similarly to siRNA. The exosomes may be co-cultured with monocytes and lymphocytes isolated from the peripheral blood of healthy donors. Therefore, it may be contemplated that exosomes containing nucleic acid-targeting system may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review). Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review). A liposome formulation may be mainly comprised of natural phospholipids and lipids such as 1,2-distearoyl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review). In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR-Cas13b complexes to the brain via an intravascular injection, which would allow whole brain transgenic animals without the need for embryonic manipulation. About 1-5 g of DNA or RNA may be contemplated for in vivo administration in liposomes.

In another embodiment, the nucleic acid-targeting system or conmponents thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific nucleic acid-targeting system targeted in a SNALP are contemplated. The daily treatment may be over about three days and then weekly for about five weeks. In another embodiment, a specific nucleic acid-targeting system encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006). In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size. In yet another embodiment, a SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol)2000) carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total nucleic acid-targeting system per dose administered as, for example, a bolus intravenous infusion may be contemplated. In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N; N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties. To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial. Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM $Na_2HPO_4$, 1 mM $KH_2PO_4$, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the nucleic acid-targeting system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate nucleic acid-targeting system or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11±0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume: 29, Pages: 154-157 (2011)) describes the use of lipid envelopes to deliver RNA. Use of lipid envelopes is also preferred in the present invention.

In another embodiment, lipids may be formulated with the RNA-targeting system (CRISPR-Cas13b complex, i.e., the Cas13b complexed with crRNA) of the present invention or component(s) thereof or nucleic acid molecule(s) coding therefor to form lipid nanoparticles (LNPs). Lipids include, but are not limited to, DLin-KC2-DMA4, C12-200 and colipids disteroylphosphatidyl choline, cholesterol, and PEG-DMG may be formulated with RNA-targeting system instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid particles (LNPs), respectively. The formulations may have mean particle diameters of ~80 nm with >90% entrapment efficiency. A 3 mg/kg dose may be contemplated. Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The RNA-targeting system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesized from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied. US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of nucleic acid-targeting system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of nucleic acid-targeting system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA should be performed to optimize the procedure for specific cell lines. (1) One day before treatment, plate $1 \times 10^5$ cells per well in a 48-well plate. (2) On the day of treatment, dilute purified +36 GFP protein in serumfree media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein-RNA complexes to cells. (5) Incubate cells with complexes at 37° C. for 4 h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

+36 GFP was found to be an effective plasmid delivery reagent in a range of cells. See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the RNA-targeting system(s) or component(s) thereof or nucleic acid molecule(s) coding therefor of the invention.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes, but is not limited to, the group consisting of therapeutic agents, diagnostic probes, peptides, nucleic acids, antisense oligonucleotides, plasmids, proteins, particles including nanoparticles, liposomes, chromophores, small molecules, and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions. The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections. CPP delivery can be used in the practice of the invention.

Implantable Devices

In another embodiment, implantable devices are also contemplated for delivery of the nucleic acid-targeting system or component(s) thereof or nucleic acid molecule(s) coding therefor. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. An implantable delivery device can be advantageous in providing release locally and over a prolonged period, where drug is released directly to the extracellular matrix (ECM) of the diseased area such as tumor, inflammation, degeneration or for symptomatic objectives, or to injured smooth muscle cells, or for prevention. One kind of drug is RNA, as disclosed above, and this system may be used/and or adapted to the nucleic acid-targeting system of the present invention. The modes of implantation in some embodiments are existing implantation procedures that are developed and used today for other treatments, including brachytherapy and needle biopsy. In such cases the dimensions of the new implant described in this invention are similar to the original implant. Typically, a few devices are implanted during the same treatment procedure.

US Patent Publication 20110195123, provideS a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 $m^3$ to 1000 $mm^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or may fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system of US Patent Publication 20110195123 is optionally associated with sensing and/or activation appliances that are operated at and/or after implantation of the device, by non and/or minimally invasive methods of activation and/or acceleration/deceleration, for example optionally including, but not limited to, thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example, the composition (optionally with the device) is optionally implanted within or in the proximity to pancreas, prostate, breast, liver, via the nipple, within the vascular system and so forth.

The target location is optionally selected from the group comprising, consisting essentially of, or consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear—auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example, but without limitation, for ovary cancer); 24. Intra esophageal and 25. Intra rectal.

Optionally, insertion of the system (for example, a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating, and cooling, and ultrasonic, including focused ultrasound and/or RF (radiofrequency) methods or devices, and chemical activators.

According to other embodiments of US Patent Publication 20110195123, the drug preferably comprises an RNA, for example, for localized cancer cases in breast, pancreas, brain, kidney, bladder, lung, and prostate as described below. Although exemplified with RNAi, many drugs are applicable to be encapsulated in Loder, and can be used in association with this invention, as long as such drugs can be encapsulated with the Loder substrate, such as a matrix for example, and this system may be used and/or adapted to deliver the nucleic acid-targeting system of the present invention.

As another example of a specific application, neuro and muscular degenerative diseases develop due to abnormal gene expression. Local delivery of RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the nucleic acid-targeting system of the present invention.

As yet another example of a specific application, psychiatric and cognitive disorders are treated with gene modifiers. Gene knockdown is a treatment option. Loders locally delivering agents to central nervous system sites are therapeutic options for psychiatric and cognitive disorders including but not limited to psychosis, bi-polar diseases, neurotic disorders, and behavioral maladies. The Loders could also deliver locally drugs including small drugs and macromolecules upon implantation at specific brain sites. All of this may be used and/or adapted to the nucleic acid-targeting system of the present invention.

As another example of a specific application, silencing of innate and/or adaptive immune mediators at local sites enables the prevention of organ transplant rejection. Local delivery of RNAs and immunomodulating reagents with the Loder implanted into the transplanted organ and/or the implanted site renders local immune suppression by repelling immune cells such as CD8 activated against the transplanted organ. All of this may be used/and or adapted to the nucleic acid-targeting system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules, and small drugs stimulating angiogenesis with the Loder is therapeutic for peripheral, systemic, and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include, but are not limited to, brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

Implantable device technology herein discussed can be employed with herein teachings and hence by this disclosure and the knowledge in the art, CRISPR-Cas system, or components thereof, or nucleic acid molecules thereof, or encoding or providing components may be delivered via an implantable device.

Patient-Specific Screening Methods

A nucleic acid-targeting system that targets RNA, e.g., trinucleotide repeats can be used to screen patients or patent samples for the presence of such repeats. The repeats can be the target of the RNA of the nucleic acid-targeting system, and if there is binding thereto by the nucleic acid-targeting system, that binding can be detected, to thereby indicate that such a repeat is present. Thus, a nucleic acid-targeting system can be used to screen patients or patient samples for the presence of the repeat. The patient can then be administered suitable compound(s) to address the condition; or can be administered a nucleic acid-targeting system to bind to and cause insertion, deletion or mutation and alleviate the condition.

The invention uses nucleic acids to bind target RNA sequences.

CRISPR Effector Protein mRNA and Guide RNA

CRISPR effector (Cas13b) protein or mRNA therefor (or more generally a nucleic acid molecule therefor) and guide RNA or crRNA might also be delivered separately e.g., the former 1-12 hours (preferably around 2-6 hours) prior to the administration of guide RNA or crRNA, or together. A second booster dose of guide RNA or crRNA can be administered 1-12 hours (preferably around 2-6 hours) after the initial administration.

The Cas13b effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have DNA or RNA binding, but not necessarily cutting or nicking, activity, including a dead-Cas effector protein function.

Cellular targets include Hemopoietic Stem/Progenitor Cells (CD34+); Human T cells; and Eye (retinal cells)—for example photoreceptor precursor cells.

Inventive methods can further comprise delivery of templates. Delivery of templates may be via the cotemporaneous or separate from delivery of any or all the CRISPR effector protein (Cas13b) or guide or crRNA and via the same delivery mechanism or different.

Inducible Systems

In some embodiments, a CRISPR effector (Cas 13b) protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, and WO 2014018423 A2, which is hereby incorporated by reference in its entirety.

Self-Inactivating Systems

Once all copies of RNA in a cell have been edited, continued Cas13b effector protein expression or activity in that cell is no longer necessary. A Self-Inactivating system that relies on the use of RNA as to the Cas13b or crRNA as the guide target sequence can shut down the system by preventing expression of Cas13b or complex formation.

Kits

In one aspect, the invention provides kits containing any one or more of the elements disclosed in the above methods and compositions. In some embodiments, the kit comprises a vector system as taught herein or one or more of the components of the CRISPR/Cas13b system or complex as taught herein, such as crRNAs and/or Cas13b effector protein or Cas13b effector protein encoding mRNA, and instructions for using the kit. Elements may be provide individually or in combinations, and may be provided in any suitable container, such as a vial, a bottle, or a tube. In some embodiments, the kit includes instructions in one or more languages, for example in more than one language. The instructions may be specific to the applications and methods described herein. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g., in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide or crRNA sequence and a regulatory element. In some embodiments, the kit comprises a homologous recombination template polynucleotide. In some embodiments, the kit comprises one or more of the vectors and/or one or more of the polynucleotides described herein. The kit may advantageously allows to provide all elements of the systems of the invention.

The invention has a broad spectrum of applications in, e.g., gene therapy, drug screening, disease diagnosis, and prognosis.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, the may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 *Nuc. Acids Research* 12 p 387). Examples of other software than may perform sequence comparisons include, but are not limited to, the BLAST package (see Ausubel et al., 1999 *Short Protocols in Molecular Biology*, 4$^{th}$ Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, *Short Protocols in Molecular Biology*, pages 7-58 to 7-60). However, for some applications, it is preferred to use the GCG Bestfit program. A new tool, called BLAST 2 Sequences is also available for comparing protein and nucleotide sequences (see *FEMS Microbiol Lett.* 1999 174 (2): 247-50; *FEMS Microbiol Lett.* 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative substitutions may be made, for example according to the table below which describes a generally accepted Venn diagram grouping of amino acids.

| Set | | Sub-set | |
|---|---|---|---|
| Hydro-phobic | F W Y H K M I L V A G C (SEQ ID NO: 132) | Aromatic Aliphatic | F W Y H I L V |
| Polar | W Y H K R E D C S T N Q (SEQ ID NO: 133) | Charged Positively charged Negatively charged | H K R E D H K R E D |
| Small | V C A G S P T N D (SEQ ID NO: 134) | Tiny | A G S |

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition. As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested. The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)). Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase. Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134. Homology modelling: Corresponding residues in other Cas13b orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking a pair a query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR. In certain aspects the invention involves vectors. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regard to recombination and cloning methods, mention is made of U.S. patent application Ser. No. 10/815,730, published Sep. 2, 2004 as US 2004-0171156 A1, the contents of which are herein incorporated by reference in their entirety. Aspects of the invention relate to bicistronic vectors for guide RNA and wild type, modified or mutated CRISPR effector proteins/enzymes (e.g. Cas13b effector proteins). Bicistronic expression vectors guide RNA and wild type, modified or mutated CRISPR effector proteins/enzymes (e.g. Cas13b effector proteins) are preferred. In general and particularly in this embodiment and wild type, modified or mutated CRISPR effector proteins/enzymes (e.g. Cas13b effector proteins) is preferably driven by the CBh promoter. The RNA may preferably be driven by a Pol III promoter, such as a U6 promoter. Ideally, the two are combined.

In some embodiments, a loop in the guide RNA or crRNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces cerevisiae* include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39). In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195).

When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989. In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873, 316 and European Application Publication No. 264,166). Developmentally-regulated promoters are also encompassed, e.g., the murine hox promoters (Kessel and Gruss, 1990. *Science* 249: 374-379) and the α-fetoprotein promoter (Campes and Tilghman, 1989. *Genes Dev.* 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regard to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

In some embodiments, a regulatory element is operably linked to one or more elements of or encoding a CRISPR Cas13b system or complex so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis* (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-

246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, *Pyrobaculum, Sulfolobus, Archaeoglobus, Haloarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azoarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "RNA-targeting system" as used in the present application refers collectively to transcripts and other elements involved in the expression of or directing the activity of RNA-targeting CRISPR-associated 13b ("Cas13b") genes (also referred to herein as an effector protein), including sequences encoding an RNA-targeting Cas (effector) protein and a guide RNA (or crRNA sequence), with reference to FIG. 1 as herein discussed. In general, an RNA-targeting system is characterized by elements that promote the formation of an RNA-targeting complex at the site of a target sequence. In the context of formation of an RNA-targeting complex, "target sequence" refers to an RNA sequence to which a guide sequence (or the guide or of the crRNA) is designed to have complementarity, where hybridization between a target sequence and a guide RNA promotes the formation of an RNA-targeting complex. Full complementarity is not necessarily required, provided there is sufficient complementarity to cause hybridization and promote formation of an RNA-targeting complex. In some embodiments, a target sequence is located in the nucleus or cytoplasm of a cell. In some embodiments, the target sequence may be within an organelle of a eukaryotic cell. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination. In general, a guide sequence is any polynucleotide sequence having sufficient complementarity with a target polynucleotide sequence to hybridize with the target sequence and direct sequence-specific binding of a nucleic acid-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of an RNA-targeting complex to a target sequence may be assessed by any suitable assay. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, 25, 30, 35, 40, 45, 50, 60, 70, 80, 90, 100 or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence. In some embodiments, the RNA-targeting effector protein is part of a fusion protein comprising one or more heterologous protein domains (e.g., about or more than about 1, 2, 3, 4, 5, 6, 7, 8, 9, 10, or more domains in addition to the nucleic acid-targeting effector protein). In some embodiments, the CRISPR Cas13b effector protein/enzyme is part of a fusion protein comprising one or more heterologous protein domains (e.g. about or more than about 1, 2, 3, 4, 5, 6, 7, 8, 9, 10, or more domains in addition to the CRISPR Cas13b enzyme). Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A nucleic acid-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a nucleic acid-targeting effector protein are described in US20110059502, incorporated herein by reference. In some embodiments, a tagged nucleic acid-targeting effector protein is used to identify the location of a target sequence. In some embodiments, a CRISPR Cas13b enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR Cas13b enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety. In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, an RNA-targeting effector protein in combination with (and optionally complexed with) a guide RNA or crRNA is delivered to a cell. Conventional viral and non-viral based gene transfer methods can be used to introduce nucleic acids in mammalian cells or target tissues. Such methods can be used to administer nucleic acids encoding components of an RNA-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, *Science* 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, *Nature* 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Bohm (eds) (1995); and Yu et al., Gene Therapy 1:13-26 (1994). Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

Models of Conditions

A method of the invention may be used to create a plant, an animal or cell that may be used to model and/or study genetic or epigenetic conditions of interest, such as a through a model of mutations of interest or a disease model. As used herein, "disease" refers to a disease, disorder, or indication in a subject. For example, a method of the invention may be used to create an animal or cell that comprises a modification in one or more nucleic acid sequences associated with a disease, or a plant, animal, or cell in which expression of one or more nucleic acid sequences associated with a disease are altered. Such a nucleic acid sequence may encode or be translated a disease associated protein sequence or may be a disease associated control sequence. Accordingly, it is understood that in embodiments of the invention, a plant, subject, patient, organism, or cell can be a non-human subject, patient, organism, or cell. Thus, the invention provides a plant, animal, or cell, produced by the present methods, or a progeny thereof. The progeny may be a clone of the produced plant or animal or may result from sexual reproduction by crossing with other individuals of the same species to introgress further desirable traits into their offspring. The cell may be in vivo or ex vivo in the cases of multicellular organisms, particularly animals or plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged. In some methods, the disease model can be used to study the effects of mutations, or more general altered, such as reduced, expression of genes or gene products on the animal or cell and development and/or progression of the disease using measures commonly used in the study of the disease. Alternatively, such a disease model is useful for studying the effect of a pharmaceutically active compound on the disease. In some methods, the disease model can be used to assess the efficacy of a potential gene therapy strategy. That is, a disease-associated RNA can be modified such that the disease development and/or progression is displayed or inhibited or reduced and then effects of a compound on the progression or inhibition or reduction are tested.

Useful in the practice of the instant invention utilizing Cas13b effector proteins and complexes thereof and nucleic acid molecules encoding same and methods using same, reference is made to: Genome-Scale CRISPR-Cas9 Knockout Screening in Human Cells. Shalem, O., Sanjana, N E., Hartenian, E., Shi, X., Scott, DA., Mikkelson, T., Heckl, D., Ebert, BL., Root, D E., Doench, JG., Zhang, F. Science December 12. (2013). [Epub ahead of print]; Published in final edited form as: Science. 2014 Jan. 3; 343(6166): 84-87. Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9. Reference is also made to US patent publication number US20140357530; and PCT Patent Publication WO2014093701, hereby incorporated herein by reference.

The term "associated with" is used here in relation to the association of the functional domain to the Cas13b effector protein or the adaptor protein. It is used in respect of how one molecule 'associates' with respect to another, for example between an adaptor protein and a functional domain, or between the Cas13b effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Cas13b effector protein or adaptor protein is associated with a functional domain by binding thereto. In other embodiments, the Cas13b effector protein or adaptor protein is associated with a functional domain because the two are fused together, optionally via an intermediate linker.

Cas13b Effector protein Complexes Can Be Used In Plants

The invention in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. The system may comprise one or more different vectors. In an aspect of the invention, the effector protein is codon optimized for expression the desired cell type, preferentially a eukaryotic cell, preferably a mammalian cell or a human cell. Cas13b system(s) (e.g., single or multiplexed) can be used in conjunction with recent advances in crop genomics. Such CRISPR system(s) can be used to perform efficient and cost effective plant gene or genome or transcriptome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. Such CRISPR system(s) can be used with regard to plants in Site-Directed Integration (SDI) or Gene Editing (GE) or any Near Reverse Breeding (NRB) or Reverse Breeding (RB) techniques. Accordingly, reference herein to animal cells may also apply, mutatis mutandis, to plant cells unless otherwise apparent; and, the enzymes herein having reduced off-target effects and systems employing such enzymes can be used in plant applciations, including those mentioned herein. Engineered plants modified by the effector protein (Cas13b) and suitable guide (crRNA), and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide. Any aspect of using classical CRIPSR-Cas systems may be adapted to use in CRISPR systems that are Cas protein agnostic, e.g. Cas13b effector protein systems.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs. The RNA targeting effector protein (Cas13b) of the invention can further be used for antiviral activity, in particular against RNA viruses. The effector protein (Cas13b) can be targeted to the viral RNA using a suitable guide RNA selective for a selected viral RNA sequence. In particular, the effector protein may be an active nuclease that cleaves RNA, such as single stranded RNA. Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

Transcriptome Wide Knock-Down Screening

The CRISPR effector protein complexes described herein can be used to perform efficient and cost effective functional transcriptomic screens. Such screens can utilize CRISPR effector protein-based transcriptome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target RNA. In preferred embodiments of the invention, the CRISPR effector protein complexes are Cas13b effector protein complexes.

In embodiments of the invention, a transcriptome wide library may comprise a plurality of Cas13b guide RNAs, as described herein, comprising guide sequences that are capable of targeting a plurality of target sequences in a plurality of loci in a population of eukaryotic cells. The population of cells may be a population of embryonic stem (ES) cells. The target sequence in the locus may be a non-coding sequence. The non-coding sequence may be an intron, regulatory sequence, splice site, 3' UTR, 5' UTR, or polyadenylation signal. *Gene* function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized by exploiting the staggered double strand breaks generated by Cas13b effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a transcriptome wide library that may comprise a plurality of cas13b guide RNAs that may comprise guide sequences that are capable of targeting a plurality of target sequences in a plurality of loci, wherein said targeting results in a knockdown of gene function. This library may potentially comprise guide RNAs that target each and every gene in the genome of an organism.

In some embodiments of the invention, the organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention, the organism or subject is a plant. In some methods of the invention, the organism or subject is a mammal or a non-human mammal. A non-human mammal may be, for example, a rodent (preferably a mouse or a rat), an ungulate, or a primate. In some methods of the invention, the organism or subject is algae, including microalgae, or is a fungus.

The knockdown of gene function may comprise introducing into each cell in the population of cells a vector system of one or more vectors comprising an engineered, non-naturally occurring Cas13b effector protein system comprising I. a Cas13b effector protein, and II. one or more guide RNAs, wherein components I and II may be same or on different vectors of the system, integrating components I and II into each cell, wherein the guide sequence targets a unique gene in each cell, wherein the Cas13b effector protein is operably linked to a regulatory element, wherein when transcribed, the guide RNA comprising the guide sequence directs sequence-specific binding of the Cas13b effector protein system to a target sequence in the genomic loci of the unique gene, inducing cleavage of the genomic loci by the Cas13b effector protein, and confirming different knockdown events in a plurality of unique genes in each cell of the population of cells thereby generating a gene knockdown cell library. The invention comprehends that the population of cells is a population of eukaryotic cells, and in a preferred embodiment, the population of cells is a population of embryonic stem (ES) cells.

The one or more vectors may be plasmid vectors. The vector may be a single vector comprising a Cas13b effector protein, a sgRNA, and optionally, a selection marker into target cells. Not being bound by a theory, the ability to simultaneously deliver a Cas13b effector protein and sgRNA through a single vector enables application to any cell type of interest, without the need to first generate cell lines that express the Cas13b effector protein. The regulatory element may be an inducible promoter. The inducible promoter may be a doxycycline inducible promoter. In some methods of the invention, the expression of the guide sequence is under the control of the T7 promoter and is driven by the expression of T7 polymerase. The confirming of different knockdown events may be by whole transcriptome sequencing. The knockdown event may be achieved in 100 or more unique genes. The knockdown event may be achieved in 1000 or more unique genes. The knockdown event may be achieved in 20,000 or more unique genes. The knockdown event may be achieved in the entire transcriptome. The knockdown of gene function may be achieved in a plurality of unique genes which function in a particular physiological pathway or condition. The pathway or condition may be an immune pathway or condition. The pathway or condition may be a cell division pathway or condition.

The invention also provides kits that comprise the transcriptome wide libraries mentioned herein. The kit may comprise a single container comprising vectors or plasmids comprising the library of the invention. The kit may also comprise a panel comprising a selection of unique Cas13b effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire transcriptome. Furthermore, a panel of target sequences may be focused on a relevant or desirable pathway, such as an immune pathway or cell division.

In an additional aspect of the invention, the Cas13b effector protein may comprise one or more mutations and may be used as a generic RNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated Cas13b effector protein being fused to domains which include, but are not limited to, a transcriptional activator, repressor, a recombinase, a transposase, a histone remodeler, a demethylase, a DNA methyltransferase, a cryptochrome, a light inducible/controllable domain, or a chemically inducible/controllable domain. Some methods of the invention can include inducing expression of targeted genes. In one embodiment, inducing expression by targeting a plurality of target sequences in a plurality of genomic loci in a population of eukaryotic cells is by use of a functional domain.

Useful in the practice of the instant invention utilizing Cas13b effector protein complexes are methods used in CRISPR-Cas9 systems and reference is made to:

Genome-Scale CRISPR-Cas9 Knockout Screening in Human Cells. Shalem, O., Sanjana, N E., Hartenian, E., Shi, X., Scott, DA., Mikkelson, T., Heckl, D., Ebert, BL., Root, D E., Doench, JG., Zhang, F. Science December 12. (2013). [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference. Functional Alteration and Screening In another aspect, the present invention provides for a method of functional evaluation and screening of genes. The use of the CRISPR system of the present invention to precisely deliver functional domains, to activate or repress genes or to alter epigenetic state by precisely altering the methylation site on a specific locus of interest, can be with one or more guide RNAs applied to a single cell or population of cells or with a library applied to genome in a pool of cells ex vivo or in vivo comprising the administration or expression of a library comprising a plurality of guide RNAs (sgRNAs) and wherein the screening further comprises use of a Cas13b effector protein, wherein the CRISPR complex comprising the Cas13b effector protein is modified to comprise a heterologous functional domain. In an aspect, the invention provides a method for screening a genome/transcriptome comprising the administration to a host or expression in a host in vivo of a library. In an aspect, the invention provides a method as herein discussed further comprising an activator administered to the host or expressed in the host. In an aspect, the invention provides a method as herein discussed wherein the activator is attached to a Cas13b effector protein. In an aspect, the invention provides a method as herein discussed wherein the activator is attached to the N terminus or the C terminus of the Cas13b effector protein. In an aspect, the invention provides a method as herein discussed wherein the activator is attached to a sgRNA loop. In an aspect, the invention provides a method as herein discussed further comprising a repressor administered to the host or expressed in the host. In an aspect, the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by Cas13b effector protein and minimizes off-target cleavage by the Cas13b effector protein. In an aspect, the invention provides guide specific binding of Cas13b effector protein at a gene locus without DNA cleavage. Accordingly, in an aspect, the invention provides target-specific gene regulation. In an aspect, the invention provides guide specific binding of Cas13b effector protein at a gene locus without DNA cleavage. Accordingly, in an aspect, the invention provides for cleavage at one locus and gene regulation at a different locus using a single Cas13b effector protein. In an aspect, the invention provides orthogonal activation and/or inhibition and/or cleavage of multiple targets using one or more Cas13b effector protein and/or enzyme.

In an aspect, the invention provides a method as herein discussed, wherein the host is a eukaryotic cell. In an aspect, the invention provides a method as herein discussed, wherein the host is a mammalian cell. In an aspect, the invention provides a method as herein discussed, wherein the host is a non-human eukaryote. In an aspect, the invention provides a method as herein discussed, wherein the non-human eukaryote is a non-human mammal. In an aspect, the invention provides a method as herein discussed, wherein the non-human mammal is a mouse. In an aspect, the invention provides a method as herein discussed comprising the delivery of the Cas13b effector protein complexes or component(s) thereof or nucleic acid molecule(s) coding therefor, wherein said nucleic acid molecule(s) are operatively linked to regulatory sequence(s) and expressed in vivo. In an aspect, the invention provides a method as herein discussed wherein the expressing in vivo is via a lentivirus, an adenovirus, or an AAV. In an aspect, the invention provides a method as herein discussed wherein the delivery is via a particle, a nanoparticle, a lipid or a cell penetrating peptide (CPP).

In an aspect, the invention provides a pair of CRISPR complexes comprising Cas13b effector protein, each comprising a guide RNA (sgRNA) comprising a guide sequence capable of hybridizing to a target sequence in a genomic locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each Cas13b effector protein complex comprises a functional domain having a DNA cleavage activity.

In an aspect, the invention provides a method for cutting a target sequence in a locus of interest comprising delivery to a cell of the Cas13b effector protein complexes or component(s) thereof or nucleic acid molecule(s) coding therefor, wherein said nucleic acid molecule(s) are operatively linked to regulatory sequence(s) and expressed in vivo. In an aspect, the invention provides a method as herein-discussed wherein the delivery is via a lentivirus, an adenovirus, or an AAV.

In an aspect, the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a DNA molecule encoding the gene product an engineered, non-naturally occurring CRISPR system comprising a Cas13b effector protein and guide RNA that targets the RNA molecule, whereby the guide RNA targets the RNA target molecule encoding the gene product and the Cas13b effector protein cleaves the RNA molecule encoding the gene product, whereby expression of the gene product is altered; and, wherein the Cas13b effector protein and the guide RNA do not naturally occur together. The invention comprehends the guide RNA comprising a guide sequence linked to a direct repeat sequence. The invention further comprehends the Cas13b effector protein being codon optimized for expression in a Eukaryotic cell. In a preferred embodiment, the Eukaryotic cell is a mammalian cell and in a more preferred embodiment the mammalian cell is a human cell. In a further embodiment of the invention, the expression of the gene product is decreased.

In some embodiments, one or more functional domains are associated with the Cas13b effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with a dead sgRNA (dRNA). In some embodiments, a dRNA complex with active Cas13b effector protein directs gene regulation by a functional domain at on gene locus while an sgRNA directs DNA cleavage by the active Cas13b effector protein at another locus, for example as described analogously in CRISPR-Cas9 systems by Dahlman et al., 'Orthogonal gene control with a catalytically active Cas9 nuclease,' Nature Biotechnology 33, p. 1159-61 (November 2015). In some embodiments, dRNAs are selected to maximize selectivity of regulation for a gene locus of interest compared to off-target regulation. In some embodiments, dRNAs are selected to maximize target gene regulation and minimize target cleavage For the purposes of the following discussion, reference to a functional domain could be a functional domain associated with the Cas13b effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising translation activation activity, translation repression activity, methylase activity, demethylase activity, transcription activation activity, transcription repression activity, transcription release factor activity, histone modification activity, RNA cleavage activity, DNA cleavage activity, DNA integration activity or nucleic acid binding activity.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the Cas13b effector protein so that upon binding to the sgRNA and target the functional domain is in a spatial orientation allowing for the functional domain to function in its attributed function.

In some embodiments, the one or more functional domains is attached to the adaptor protein so that upon binding of the Cas13b effector protein to the sgRNA and target, the functional domain is in a spatial orientation allowing for the functional domain to function in its attributed function.

In an aspect, the invention provides a composition as herein discussed wherein the one or more functional domains is attached to the Cas13b effector protein or adaptor protein via a linker, optionally a GlySer linker, as discussed herein.

It is also preferred to target endogenous (regulatory) control elements, such as involved in translation, stability, etc. Targeting of known control elements can be used to activate or repress the gene of interest. Targeting of putative control elements on the other hand can be used as a means to verify such elements (by measuring the translation of the gene of interest) or to detect novel control elements. In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a Cas13b effector protein as described herein, preferably a dead-Cas13b effector protein, more preferably a dead-FnCas13b effector protein, to target epigenomic sequences can be used to activate or repress promoters, silencer, or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6 Apr. 2015).

In some preferred embodiments, the functional domain is linked to a dead-Cas13b effector protein to target and activate epigenomic sequences such as promoters or enhancers. One or more guides directed to such promoters or enhancers may also be provided to direct the binding of the CRISPR enzyme to such promoters or enhancers.

In certain embodiments, the RNA targeting effector protein of the invention can be used to interfere with co-transcriptional modifications of DNA/chromatin structure, RNA-directed DNA methylation, or RNA-directed silencing/activation of DNA/chromatin. RNA-directed DNA methylation (RdDM) is an epigenetic process first discovered in plants. During RdDM, double-stranded RNAs (dsRNAs) are processed to 21-24 nucleotide small interfering RNAs (siRNAs) and guide methylation of homologous DNA loci. Besides RNA molecules, a plethora of proteins are involved in the establishment of RdDM, like Argonautes, DNA methyltransferases, chromatin remodelling complexes and the plant-specific PolIV and PolV. All these act in concert to add a methyl-group at the 5' position of cytosines. Small RNAs can modify the chromatin structure and silence transcription by guiding Argonaute-containing complexes to complementary nascent (non-coding) RNA trancripts. Subsequently, the recruitment of chromatin-modifying complexes, including histone and DNA methyltransferases, is mediated. The RNA targeting effector protein of the invention may be used to target such small RNAs and interfere in interactions between these small RNAs and the nascent non-coding transcripts.

The term "associated with" is used here in relation to the association of the functional domain to the Cas13b effector protein or the adaptor protein. It is used in respect of how one molecule 'associates' with respect to another, for example between an adaptor protein and a functional domain, or between the Cas13b effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the Cas13b effector protein or adaptor protein is associated with a functional domain by binding thereto. In other embodiments, the Cas13b effector protein or adaptor protein is associated with a functional domain because the two are fused together, optionally via an intermediate linker.

Saturating Mutagenesis

The Cas13b effector protein system(s) described herein can be used to perform saturating or deep scanning mutagenesis of genomic loci in conjunction with a cellular phenotype—for instance, for determining critical minimal features and discrete vulnerabilities of functional elements required for gene expression, drug resistance, and reversal of disease. By saturating or deep scanning mutagenesis is meant that every or essentially every RNA base is cut within the genomic loci. A library of Cas13b effector protein guide RNAs may be introduced into a population of cells. The library may be introduced, such that each cell receives a single guide RNA (sgRNA). In the case where the library is introduced by transduction of a viral vector, as described herein, a low multiplicity of infection (MOI) is used. The library may include sgRNAs targeting every sequence upstream of a (protospacer adjacent motif) (PAM) sequence in a genomic locus. The library may include at least 100 non-overlapping genomic sequences upstream of a PAM sequence for every 1000 base pairs within the genomic locus. The library may include sgRNAs targeting sequences upstream of at least one different PAM sequence. The Cas13b effector protein systems may include more than one Cas13b protein. Any Cas13b effector protein as described herein, including orthologues, or engineered Cas13b effector proteins that recognize different PAM sequences may be used. The frequency of off target sites for a sgRNA may be less than 500. Off target scores may be generated to select sgRNAs with the lowest off target sites. Any phenotype determined to be associated with cutting at a sgRNA target site may be confirmed by using sgRNAs targeting the same site in a single experiment. Validation of a target site may also be performed by using a modified Cas13b effector protein, as described herein, and two sgRNAs targeting the genomic site of interest. Not being bound by a theory, a target site is a true hit if the change in phenotype is observed in validation experiments.

The Cas13b effector protein system(s) for saturating or deep scanning mutagenesis can be used in a population of cells. The Cas13b effector protein system(s) can be used in eukaryotic cells, including but not limited to mammalian and plant cells. The population of cells may be prokaryotic cells. The population of eukaryotic cells may be a population of embryonic stem (ES) cells, neuronal cells, epithelial cells, immune cells, endocrine cells, muscle cells, erythrocytes, lymphocytes, plant cells, or yeast cells.

In one aspect, the present invention provides for a method of screening for functional elements associated with a change in a phenotype. The library may be introduced into a population of cells that are adapted to contain a Cas13b effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for loci associated with resistance to a chemical compound. The chemical compound may be a drug or pesticide. The library may be introduced into a population of cells that are adapted to contain a Cas13b effector protein, wherein each cell of the population contains no more than one guide RNA; the population of cells are treated with the chemical compound; and the representation of guide RNAs are determined after treatment with the chemical compound at a later time point as compared to an early time point, whereby genomic sites associated with resistance to the chemical compound are determined by enrichment of guide RNAs. Representation of sgRNAs may be determined by deep sequencing methods.

Useful in the practice of the instant invention utilizing Cas13b effector protein complexes are methods used in CRISPR-Cas9 systems and reference is made to the article entitled BCL11A enhancer dissection by Cas9-mediated in situ saturating mutagenesis. Canver, M. C., Smith, E. C., Sher, F., Pinello, L., Sanjana, N. E., Shalem, O., Chen, D. D., Schupp, P. G., Vinjamur, D. S., Garcia, S. P., Luc, S., Kurita, R., Nakamura, Y., Fujiwara, Y., Maeda, T., Yuan, G., Zhang, F., Orkin, S. H., & Bauer, D. E. DOI:10.1038/nature15521, published online Sep. 16, 2015, the article is herein incorporated by reference and discussed briefly below:

Canver et al. involves novel pooled CRISPR-Cas9 guide RNA libraries to perform in situ saturating mutagenesis of the human and mouse BCL11A erythroid enhancers previously identified as an enhancer associated with fetal hemoglobin (HbF) level and whose mouse ortholog is necessary for erythroid BCL11A expression. This approach revealed critical minimal features and discrete vulnerabilities of these enhancers. Through editing of primary human progenitors and mouse transgenesis, the authors validated the BCL11A erythroid enhancer as a target for HbF reinduction. The authors generated a detailed enhancer map that informs therapeutic genome editing.

Method of Using Cas13b Systems to Modify a Cell or Organism

The invention in some embodiments comprises a method of modifying a cell or organism. The cell may be a prokaryotic cell or a eukaryotic cell. The cell may be a mammalian cell. The mammalian cell many be a non-human primate, bovine, porcine, rodent, or mouse cell. The cell may be a non-mammalian eukaryotic cell such as poultry, fish, or shrimp. The cell may also be a plant cell. The plant cell may be of a crop plant such as cassava, corn, sorghum, wheat, or rice. The plant cell may also be of an algae, tree, or vegetable. The modification introduced to the cell by the present invention may be such that the cell and progeny of the cell are altered for improved production of biologic products such as an antibody, starch, alcohol, or other desired cellular output. The modification introduced to the cell by the present invention may be such that the cell and progeny of the cell include an alteration that changes the biologic product produced.

The system may comprise one or more different vectors. In an aspect of the invention, the effector protein is codon optimized for expression the desired cell type, preferentially a eukaryotic cell, preferably a mammalian cell or a human cell.

Packaging cells are typically used to form virus particles that are capable of infecting a host cell. Such cells include 293 cells, which package adenovirus, and W2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a nucleic acid-targeting system as described herein (such as by transient transfection of one or more vectors, or transfection with RNA), and modified through the activity of a nucleic acid-targeting complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In certain embodiments, the organism or subject is a plant. In certain embodiments, the organism or subject or plant is algae. Methods for producing transgenic plants and animals are known in the art, and generally begin with a method of cell transfection, such as described herein.

In one aspect, the invention provides for methods of modifying a target polynucleotide in a eukaryotic cell. In some embodiments, the method comprises allowing a nucleic acid-targeting complex to bind to the target polynucleotide to effect cleavage of said target polynucleotide thereby modifying the target polynucleotide, wherein the nucleic acid-targeting complex comprises a nucleic acid-targeting effector protein complexed with a guide RNA hybridized to a target sequence within said target polynucleotide.

In one aspect, the invention provides a method of modifying expression of a polynucleotide in a eukaryotic cell. In some embodiments, the method comprises allowing a nucleic acid-targeting complex to bind to the polynucleotide such that said binding results in increased or decreased expression of said polynucleotide; wherein the nucleic acid-targeting complex comprises a nucleic acid-targeting effector protein complexed with a guide RNA hybridized to a target sequence within said polynucleotide.

Cas13b Effector Protein Complexes can be Used in Plants

The Cas13b effector protein system(s) (e.g., single or multiplexed) can be used in conjunction with recent advances in crop genomics. The systems described herein can be used to perform efficient and cost-effective plant gene or genome interrogation or editing or manipulation—for instance, for rapid investigation and/or selection and/or interrogations and/or comparison and/or manipulations and/or transformation of plant genes or genomes, e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The Cas13b effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described Cas13b effector protein systems may be analogous to the use of the CRISPR-Cas (e.g. CRISPR-Cas9) system in plants, and mention is made of the University of Arizona website "CRISPR-PLANT" (www.genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi: 10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the Agrobacterium tumefaciens-mediated CRISPR-Cas system in rice," Rice 2014, 7:5 (2014), Zhou et al., "Exploiting SNPs for biallelic CRISPR mutations in the outcrossing woody perennial Populus reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061—Agrobacterium-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and the enzymes herein having reduced off-target effects and systems employing such enzymes can be used in plant applciations, including those mentioned herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort Marchantia polymorpha L., which has emerged as a model species for studying land plant evolution. The U6 promoter of M. polymorpha was identified and cloned to express the gRNA. The target sequence of the gRNA was designed to disrupt the gene encoding auxin response factor 1 (ARF1) in M. polymorpha. Using Agrobacterium-mediated transformation, Sugano et al. isolated stable mutants in the gametophyte generation of M. polymorpha. CRISPR-Cas9-based site-directed mutagenesis in vivo was achieved using either the Cauliflower mosaic virus 35S or M. polymorpha EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR/Cas9-based targeted mutagenesis. The Cas13b systems of the present invention can be used to regulate the same as well as other genes, and like expression control systesm such as RNAi and siRNA, the method of the invention can be inducible and reversible.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The instant invention can be used to regulate the plant genes of Kabadi.

Xing et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA) module vector set, as a toolkit for multiplex genome editing in plants. The Cas13b systems and proteins of the instant invention may be used to target the genes targeted by Xing.

The Cas13b CRISPR systems of the invention may be used in the detection of plant viruses. Gambino et al. (Phytopathology. 2006 November; 96(11):1223-9. doi: 10.1094/PHYTO-96-1223) relied on amplification and multiplex PCR for simultaneous detection of nine grapevine viruses. The Cas13b systems and proteins of the instant invention may similarly be used to detect multiple targets in a host. Moreover, the systems of the invention can be used to simultaneously knock down viral gene expression in valuable cultivars, and prevent activation or further infection by targeting expressed viral RNA.

Murray et al. (Proc Biol Sci. 2013 Jun. 26; 280(1765): 20130965. doi: 10.1098/rspb.2013.0965; published 2013 Aug. 22) analyzed 12 plant RNA viruses to investigate evolutionary rates and found evidence of episodic selection possibly due to shifts between different host genotyopes or species. The Cas13b systems and proteins of the instant invention may be used to target or immunize against such viruses in a host. For example, the systems of the invention can be used to block viral RNA expression hence replication. Also, the invention can be used to target nucleic acids for cleavage as will as to target expression or activation. Moreover, the systems of the invention can be multiplexed so as to hit multiple targets or multiple isolate of the same virus.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in TO rice and T1*Arabidopsis* plants by simultaneous targeting of multiple (up to eight) members of a gene family, multiple genes in a biosynthetic pathway, or multiple sites in a single gene. Similarly, the Cas13b systems of the instant invention can efficiently target expression of multiple genes simultaneously.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modern plant biotechnology, genetics, molecular biology and physiology. As such, we developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the Cas13b effector protein system of the present invention.

Organisms such as yeast and microalgae are widely used for synthetic biology. Stovicek et al. (Metab. Eng. Comm., 2015; 2:13 describes genome editing of industrial yeast, for example, *Saccharomyces cerevisiae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2-based vector locations. The authors also showed that gene disruption efficiency could be improved by optimization of the levels of Cas9 and gRNA expression. Hlavová et al. (Biotechnol. Adv. 2015) discusses development of species or strains of microalgae using techniques such as CRISPR to target nuclear and chloroplast genes for insertional mutagenesis and screening. The same plasmids and vectors can be applied to the Cas13b systems of the instant invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the Cas13b effector protein system of the present invention.

Kurth et al, J Virol. 2012 June; 86(11):6002-9. doi: 10.1128/JVI.00436-12. Epub 2012 Mar. 21) developed an RNA virus-based vector for the introduction of desired traits into grapevine without heritable modifications to the genome. The vector provided the ability to regulate expression of endogenous genes by virus-induced gene silencing. The Cas13b systems and proteins of the instant invention can be used to silence genes and proteins without heritable modification to the genome.

In an embodiment, the plant may be a legume. The present invention may utilize the herein disclosed CRISPR-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in *Medicago*.

The Cas13b systems and proteins of the instant invention can be used to knockout/knockdown systems.

Peanut allergies and allergies to legumes generally are a real and serious health concern. The Cas13b effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the Cas13b effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula* x alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformations, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the Cas13b effector protein system of the present invention.

In plants, pathogens are often host-specific. For example, *Fusarium oxysporum* f. sp. *lycopersici* causes tomato wilt but attacks only tomato, and *F. oxysporum* f. *dianthii Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide.

Therapeutic Treatment

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations). Expression of the toxic RNA may be associated with formation of nuclear inclusions and late-onset degenerative changes in brain, heart or skeletal muscle. In the best studied example, myotonic dystrophy, it appears that the main pathogenic effect of the toxic RNA is to sequester binding proteins and compromise the regulation of alternative splicing (Hum. Mol. Genet. (2006) 15 (suppl 2): R162-R169). Myotonic dystrophy [dystrophia myotonica (DM)] is of particular interest to geneticists because it produces an extremely wide range of clinical features. A partial listing would include muscle wasting, cataracts, insulin resistance, testicular atrophy, slowing of cardiac conduction, cutaneous tumors and effects on cognition. The classical form of DM, which is now called DM type 1 (DM1), is caused by an expansion of CTG repeats in the 3'-untranslated region (UTR) of DMPK, a gene encoding a cytosolic protein kinase.

The below table presents a list of exons shown to have misregulated alternative splicing in DM1 skeletal muscle, heart or brain.

| Tissue/gene Target | | Reference |
|---|---|---|
| Skeletal muscle | | |
| ALP | ex 5a, 5b | Lin X., et al. Failure of MBNL1-dependent postnatal splicing transitions in myotonic dystrophy. Hum. Mol. Genet 2006; 15: 2087-2097 |
| CAPN3 | ex 16 | Lin X., et al. Failure of MBNL1-dependent postnatal splicing transitions in myotonic dystrophy. Hum. Mol. Genet 2006; 15: 2087-2097 |
| CLCN1 | int 2, ex 7a, 8a | Mankodi A., et al. Expanded CUG repeats trigger aberrant splicing of ClC-1 chloride channel pre-mRNA and hyperexcitability of skeletal muscle in myotonic dystrophy. Mol. Cell 2002; 10: 35-44<br>Charlet-B N., et al. Loss of the muscle-specific chloride channel in type 1 myotonic dystrophy due to misregulated alternative splicing. Mol. Cell 2002; 10: 45-53 |
| FHOS | ex 11a | Lin X., et al. Failure of MBNL1-dependent postnatal splicing transitions in myotonic dystrophy. Hum. Mol. Genet 2006; 15: 2087-2097 |
| GFAT1 | ex 10 | Lin X., et al. Failure of MBNL1-dependent postnatal splicing transitions in myotonic dystrophy. Hum. Mol. Genet 2006; 15: 2087-2097 |
| IR | ex 11 | Savkur R. S., et al. Aberrant regulation of insulin receptor alternative splicing is associated with insulin resistance in myotonic dystrophy. Nat. Genet. 2001; 29: 40-47 |
| MBNL1 | ex 7 | Lin X., et al. Failure of MBNL1-dependent postnatal splicing transitions in myotonic dystrophy. Hum. Mol. Genet 2006; 15: 2087-2097 |
| MBNL2 | ex 7 | Lin X., et al. Failure of MBNL1-dependent postnatal splicing transitions in myotonic dystrophy. Hum. Mol. Genet 2006; 15: 2087-2097 |
| MTMR1 | ex 2.1, 2.2 | Buj-Bello A., et al. Muscle-specific alternative splicing of myotubularin-related 1 gene is impaired in DM1 muscle cells. Hum. Mol. Genet. 2002; 11: 2297-2307 |
| NRAP | ex 12 | Lin X., et al. Failure of MBNL1-dependent postnatal splicing transitions in myotonic dystrophy. Hum. Mol. Genet 2006; 15: 2087-2097 |
| RYR1 | ex 70 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200 |
| SERCA1 | ex 22 | Kimura T., et al. Altered mRNA splicing of the skeletal muscle ryanodine receptor and sarcoplasmic/endoplasmic reticulum Ca2+-ATPase in myotonic dystrophy type 1. Hum. Mol. Genet. 2005; 14: 2189-2200<br>Lin X., et al. Failure of MBNL1-dependent postnatal splicing transitions in myotonic dystrophy. Hum. Mol. Genet 2006; 15: 2087-2097 |
| z-Titin | ex Zr4, Zr5 | Lin X., et al. Failure of MBNL1-dependent postnatal splicing transitions in myotonic dystrophy. Hum. Mol. Genet 2006; 15: 2087-2097 |
| m-Titin | M-line ex5 | Lin X., et al. Failure of MBNL1-dependent postnatal splicing transitions in myotonic dystrophy. Hum. Mol. Genet 2006; 15: 2087-2097 |
| TNNT3 | fetal ex | Kanadia R. N., et al. A muscleblind knockout model for myotonic dystrophy. Science 2003; 302: 1978-1980 |
| ZASP | ex 11 | Lin X., et al. Failure of MBNL1-dependent postnatal splicing transitions in myotonic dystrophy. Hum. Mol. Genet 2006; 15: 2087-2097 |
| Heart | | |
| TNNT2 | ex 5 | Philips A. V., et al. Disruption of splicing regulated by a CUG-binding protein in myotonic dystrophy. Science 1998; 280: 737-741 |
| ZASP | ex 11 | Mankodi A., et al. Nuclear RNA foci in the heart in myotonic dystrophy. Circ. Res. 2005; 97: 1152-1155 |
| m-Titin | M-line ex 5 | Mankodi A., et al. Nuclear RNA foci in the heart in myotonic dystrophy. Circ. Res. 2005; 97: 1152-1155 |
| KCNAB1 | ex 2 | Mankodi A., et al. Nuclear RNA foci in the heart in myotonic dystrophy. Circ. Res. 2005; 97: 1152-1155 |
| ALP | ex 5 | (Mankodi A., et al. Nuclear RNA foci in the heart in myotonic dystrophy. Circ. Res. 2005; 97: 1152-1155 |
| Brain | | |
| TAU | ex 2, ex 10 | Sergeant N., et al. Dysregulation of human brain microtubule-associated tau mRNA maturation in myotonic dystrophy type 1. Hum. Mol. Genet. 2001; 10: 2143-2155<br>Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |

-continued

| Tissue/gene Target | Reference |
|---|---|
| APP ex 7 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |
| NMDAR1 ex 5 | Jiang H., et al. Myotonic dystrophy type 1 associated with nuclear foci of mutant RNA, sequestration of muscleblind proteins, and deregulated alternative splicing in neurons. Hum. Mol. Genet. 2004; 13: 3079-3088 |

The enzymes of the present invention may target overexpressed RNA or toxic RNA, such as for example, the DMPK gene or any of the misregulated alternative splicing in DM1 skeletal muscle, heart or brain in, for example, the above table.

The enzymes of the present invention may also target trans-acting mutations affecting RNA-dependent functions that cause disease (summarized in Cell. 2009 Feb. 20; 136(4): 777-793) as indicated in the below table.

| DISEASE | GENE/MUTATION | FUNCTION |
|---|---|---|
| Prader Willi syndrome | SNORD116 | ribosome biogenesis |
| Spinal muscular atrophy (SMA) | SMN2 | splicing |
| Dyskeratosis congenita (X-linked) | DKC1 | telomerase/translation |
| Dyskeratosis congenita (autosomal dominant) | TERC | telomerase |
| Dyskeratosis congenita (autosomal dominant) | TERT | telomerase |
| Diamond-Blackfan anemia | RPS19, RPS24 | ribosome biogenesis |
| Shwachman-Diamond syndrome | SBDS | ribosome biogenesis |
| Treacher-Collins syndrome | TCOF1 | ribosome biogenesis |
| Prostate cancer | SNHG5 | ribosome biogenesis |
| Myotonic dystrophy, type 1 (DM1) | DMPK (RNA gain-of-function) | protein kinase |
| Myotonic dystrophy type 2 (DM2) | ZNF9 (RNA gain-of-function) | RNA binding |
| Spinocerebellar ataxia 8 (SCA8) | ATXN8/ATXN8OS (RNA gain-of-function) | unknown/noncoding RNA |
| Huntington's disease-like 2 (HDL2) | JPH3 (RNA gain-of-function) | ion channel function |
| Fragile X-associated tremor ataxia syndrome (FXTAS) | FMR1 (RNA gain-of-function) | translation/mRNA localization |
| Fragile X syndrome | FMR1 | translation/mRNA localization |
| X-linked mental retardation | UPF3B | translation/nonsense mediated decay |
| Oculopharyngeal muscular dystrophy (OPMD) | PABPN1 | 3' end formation |
| Human pigmentary genodermatosis | DSRAD | editing |
| Retinitis pigmentosa | PRPF31 | splicing |
| Retinitis pigmentosa | PRPF8 | splicing |
| Retinitis pigmentosa | HPRP3 | splicing |
| Retinitis pigmentosa | PAP1 | splicing |
| Cartilage-hair hypoplasia (recessive) | RMRP | splicing |
| Autism | 7q22-q33 locus breakpoint | noncoding RNA |
| Beckwith-Wiedemann syndrome (BWS) | H19 | noncoding RNA |
| Charcot-Marie-Tooth (CMT) Disease | GRS | translation |
| Charcot-Marie-Tooth (CMT) Disease | YRS | translation |
| Amyotrophic lateral sclerosis (ALS) | TARDBP | splicing, transcription |
| Leukoencephalopathy with vanishing white matter | EIF2B1 | translation |
| Wolcott-Rallison syndrome | EIF2AK3 | translation (protease) |
| Mitochondrial myopathy and sideroblastic anemia (MLASA) | PUS1 | translation |
| Encephalomyopathy and hypertrophic cardiomyopathy | TSFM | translation (mitochondrial) |
| Hereditary spastic paraplegia | SPG7 | ribosome biogenesis |
| Leukoencephalopathy | DARS2 | translation (mitochondrial) |
| Susceptibility to diabetes mellitus | LARS2 | translation (mitochondrial) |
| Deafness | MTRNR1 | ribosome biogenesis (mitochondrial) |
| MELAS syndrome, deafness | MTRNR2 | ribosome biogenesis (mitochondrial) |
| Cancer | SFRS1 | splicing, translation, export |
| Cancer | RBM5 | splicing |
| Multiple disorders | mitochondrial tRNA mutations | translation (mitochondrial) |
| Cancer | miR-17-92 cluster | RNA interference |
| Cancer | miR-372/miR-373 | RNA interference |

The enzyme of the present invention may also be used in the treatment of various tauopathies, including primary and secondary tauopathies, such as primary age-related tauopathy (PART)/Neurofibrillary tangle-predominant senile dementia, with NFTs similar to AD, but without plaques, dementia pugilistica (chronic traumatic encephalopathy), progressive supranuclear palsy, corticobasal degeneration, frontotemporal dementia and parkinsonism linked to chromosome 17, lytico-Bodig disease (Parkinson-dementia complex of Guam), ganglioglioma and gangliocytoma, meningioangiomatosis, postencephalitic parkinsonism, subacute sclerosing panencephalitis, as well as lead encephalopathy, tuberous sclerosis, Hallervorden-Spatz disease, and lipofuscinosis, alzheimers disease. The enzymes of the present invention may also target mutations disrupting the cis-acting splicing code cause splicing defects and disease (summarized in Cell. 2009 Feb. 20; 136(4): 777-793). The motor neuron degenerative disease SMA results from deletion of the SMN1 gene. The remaining SMN2 gene has a C→T substitution in exon 7 that inactivates an exonic splicing enhancer (ESE), and creates an exonic splicing silencer (ESS), leading to exon 7 skipping and a truncated protein (SMNΔ7). A T→A substitution in exon 31 of the dystrophin gene simultaneously creates a premature termination codon (STOP) and an ESS, leading to exon 31 skipping. This mutation causes a mild form of DMD because the mRNA lacking exon 31 produces a partially functional protein. Mutations within and downstream of exon 10 of the MAPT gene encoding the tau protein affect splicing regulatory elements and disrupt the normal 1:1 ratio of mRNAs including or excluding exon 10. This results in a perturbed balance between tau proteins containing either four or three microtubule-binding domains (4R-tau and 3R-tau, respectively), causing the neuropathological disorder FTDP-17. The example shown is the N279K mutation which enhances an ESE function promoting exon 10 inclusion and shifting the balance toward increased 4R-tau. Polymorphic (UG)m(U)n tracts within the 3' splice site of the CFTR gene exon 9 influence the extent of exon 9 inclusion and the level of full-length functional protein, modifying the severity of cystic fibrosis (CF) caused by a mutation elsewhere in the CFTR gene.

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs.

The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent.

Therapeutic dosages of the enzyme system of the present invention to target RNA the above-referenced RNAs are contemplated to be about 0.1 to about 2 mg/kg the dosages may be administered sequentially with a monitored response, and repeated dosages if necessary, up to about 7 to 10 doses per patient. Advantageously, samples are collected from each patient during the treatment regimen to ascertain the effectiveness of treatment. For example, RNA samples may be isolated and quantified to determine if expression is reduced or ameliorated. Such a diagnostic is within the purview of one of skill in the art.

Transcript Detection Methods

The effector proteins and systems of the invention are useful for specific detection of RNAs in a cell or other sample. In the presence of an RNA target of interest, guide-dependent Cas13b nuclease activity may be accompanied by non-specific RNase activity against collateral targets. To take advantage of the RNase activity, all that is needed is a reporter substrate that can be detectably cleaved. For example, a reporter molecule can comprise RNA, tagged with a fluorescent reporter molecule (fluor) on one end and a quencher on the other. In the absence of Cas13b RNase activity, the physical proximity of the quencher dampens fluorescence from the fluor to low levels. When Cas13b target specific cleavage is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength.

In an aspect, the invention relates to a (target) RNA detection system comprising an RNA targeting effector; one or more guide RNAs designed to bind to the corresponding RNA target; and an RNA-based cleavage inducible reporter construct. In another aspect, the invention relates to a method for (target) RNA detection in a sample, comprising adding an RNA targeting effector, one or more guide RNAs designed to bind to said (target) RNA, and an RNA-based cleavage inducible reporter construct to said sample. In a further aspect, the invention relates to a kit or device comprising the (target) RNA detection system as defined herein, or a kit or device comprising at least the RNA targeting effector and the RNA-based cleavage inducible reporter construct. In a further aspect, the invention relates to the use of the RNA targeting system or kit or device as defined herein for (target) RNA detection. The RNA targeting effector in certain embodiments is an RNA guided RNAse. In certain embodiments, the RNA targeting effector is a CRISPR effector. In certain embodiments, the RNA targeting effector is a class 2 CRISPR effector. In certain embodiments, the RNA targeting effector is a class 2, type VI-B CRISPR effector. In a preferred embodiment, the RNA targeting effector is Cas13b. In certain embodiments, the RNA targeting effector, preferably Cas13b, is derived from a species as described herein elsewhere. It will be understood that the guide RNA designed to bind to said (target) RNA as described herein is capable of forming a complex with the RNA targeting effector and wherein the guide RNA in said complex is capable of binding to a target RNA molecule and whereby the target RNA is cleaved, as also described herein elsewhere. It will be understood that the guide RNA typically comprises a guide sequence and a direct repeat, as described herein elsewhere. In certain embodiments, the one or more guide RNAs are designed to bind to one or more target molecules that are diagnostic for a disease state. In certain embodiments, the disease state is infection, such as viral, bacterial, fungal, or parasitic infection. In certain embodiments, the disease state is characterised by aberrant (target) RNA expression. In certain embodiments, the disease state is cancer. In certain embodiments, the disease state is autoimmune disease. The RNA-based cleavage inducible reporter construct comprises RNA and cleavage of the RNA results in a detectable readout, i.e. a detectable signal is generated upon cleavage of the RNA. In certain embodiments, the RNA-based cleavage inducible reporter construct comprises a fluorochrome and a quencher. The skilled person will understand that different types of fluorochromes and corresponding quenchers may be used. The skilled person will readily envisage other types of inducible reporter systems which may be adapted for use in the present RNA cleavage reporter constructs.

In one exemplary assay method, Cas13b effector, target-of-interest-specific guide RNA, and reporter molecule are added to a cellular sample. An increase in fluorescence indicates the presence of the RNA target-of-interest. In another exemplary method, a detection array is provided. Each location of the array is provided with Cas13b effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

As used herein, a "masking construct" refers to a molecule that can be cleaved or otherwise deactivated by an activated CRISPR system effector protein described herein. In certain example embodiments, the masking construct is an RNA-based masking construct. The masking construct prevents the generation or detection of a positive detectable signal. A positive detectable signal may be any signal that can be detected using optical, fluorescent, chemiluminescent, electrochemical or other detection methods known in the art. The masking construct may prevent the generation of a detectable positive signal or mask the presence of a detectable positive signal until the masking construct is removed or otherwise silenced. The term "positive detectable signal" is used to differentiate from other detectable signals that may be detectable in the presence of the masking construct. For example, in certain embodiments a first signal may be detected when the masking agent is present (i.e. a negative detectable signal), which then converts to a second signal (e.g. the positive detectable signal) upon detection of the target molecules and cleavage or deactivation of the masking agent by the activated CRISPR effector protein.

In certain example embodiments, the masking construct may suppress generation of a gene product. The gene product may be encoded by a reporter construct that is added to the sample. The masking construct may be an interfering RNA involved in an RNA interference pathway, such as a shRHN or siRNA. The masking construct may also comprise microRNA (miRNA). While present, the masking construct suppresses expression of the gene product. The gene product may be a fluorescent protein or other RNA transcript or proteins that would otherwise be detectable by a labeled probe or antibody but for the presence of the masking construct. Upon activation of the effector protein the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such a purpose. In certain example embodiments, the one or more reagents are sequestered by RNA aptamers that bind the one or more reagents. The one or more reagents are released when the effector protein is activated upon detection of a target molecule. In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more RNA aptamers to the protein. Upon activation of the effector proteins disclosed herein, the RNA aptamers are cleaved or degraded to the extent they no longer inhibit the protein's ability to generate the detectable signal.

In one embodiment, thrombin is used as a signal amplification enzyme with an inhibitory aptamer, for example having the following sequence: GGGAACAAAGCUGA-AGUACUUACCC (SEQ ID NO: 135). When this aptamer is cleaved, thrombin becomes active and will cleave a peptide colorimetric substrate (see, e.g., www.sigmaaldrich.com/catalog/product/sigma/t3068?lang=en&region=US) or fluorescent substrate (see, e.g., www.sigmaaldrich.com/catalog/product/sigma/b9385?lang=en&region=US). The colorimetric substrate, para-nitroanilide (pNA), is covalently linked to the peptide substrate for thrombin. Upon cleavage by thrombin, pNA is released and becomes yellow in color and easily visible by eye. The fluorescent substrate operates by a similar principle and, upon cleavage by thrombin, releases 7-amino-4-methylcoumarin, a blue fluorophore that can be detected using a fluorescence detector. Alternatives to thrombin include horseradish peroxidase (HRP), 0-galactosidase, and calf alkaline phosphatase (CAP) which can similarly be used to generate a colorimetric or fluorescent signal and be inhibited by an inhibitory aptamer.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is an RNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is an RNA aptamer. The immobilized reagent may be a protein and the labeled minding partner may be a labeled antibody. Alternatively, the immobilized reagent may be a streptavidin and the labeled binding partner may be labeled biotin. The label on the binding partner used in the above embodiments may be any detectable label known in the art. In addition, other known binding partners may be used in accordance with the overall design described here.

In certain example embodiments, the masking construct may comprise a ribozyme. Ribozymes are RNA molecules having catalytic properties. As ribozymes, both naturally and engineered, comprise or consist of RNA, that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein molecule the reaction generating a negative controls signal or preventing generation of a positive detectable signal is removed, thereby allowing a positive detectable signal to be detected. In one example embodiment, the ribozyme may catalyze a colorimetric reaction causing a solution to appear as a first color. When the ribozyme is deactivated the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," Biosens Bioelectron. 2014; 16:337-42, and provide an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. At least a portion of the bridge molecule comprises RNA. Upon activation of the effector proteins dislcosed herein, the RNA portion of the bridge molecule is cleaved allowing the detection agent to disperse and resulting in the corresponding change in color. In certain example embodiments the, bridge molecule is an RNA molecule. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and IIIB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al^{3+}$, $Ru^{3+}$, $Zn^{2+}$, $Fe^{3+}$, $Ni^{2+}$ and $Ca^{2+}$ ions.

In certain other example embodiments, the masking construct may comprise an RNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA oligonucleotide is cleaved thereby severing the proximity between the fluorophore and quencher needed to maintain the contact quenching effect. Accordingly, detection of the fluorophore may be used to determine the presence of a target molecule in a sample.

In one example embodiment, the masking construct may comprise a quantum dot. The quantum dot may have multiple linker molecules attached to the surface. At least a portion of the linker molecule comprises RNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA portion of the linker molecule is cleaved thereby eliminating the proximity between the quantum dot and one or more quenchers needed to maintain the quenching effect. In one embodiment, the quantum dot is streptavidin conjugated, such as Qdot® 625 Streptavidin Conjugate (www.thermofisher.com/order/catalog/product/A10196). RNA is attached via biotin linkers and recruit quenching molecules, with the sequence /5Biosg/UCUCGUACGUUC/3IAbRQSp/ (SEQ ID NO: 136) or /5Biosg/UCUCGUACGUUCUCUCGUACGUUC/3IAbRQSp/ (SEQ ID NO: 137) where /5Biosg/ is a biotin tag and /3IAbRQSp/ is an Iowa black quencher. Upon cleavage, the quencher will be released, and the quantum dot will fluoresce visibly.

In a similar fashion, fluorescence energy transfer (FRET) may be used to generate a detectable positive signal. FRET is a non-radiative process by which a photon from an energetically excited fluorophore (i.e. "donor fluorophore") raises the energy state of an electron in another molecule (i.e. "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is loss as heat. Thus, in the context of the embodiments disclosed herein, the fluorophore/quencher pair is replaced with a donor fluorophore/acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

One mode of colorimetric readout for the detection of RNAses is based upon intercalating dyes, which change their absorbance in response to cleavage of long RNAs to short nucleotides. Several existing dyes with these properties exist. From Wagner (1983), Pyronine-Y will complex with RNA and form a complex that has an absorbance at 572 nm; cleavage of RNA results in loss of absorbance and a color change. Greiner-Stoeffele (1996) used methylene blue in a similar fashion, with changes in absorbance at 688 nm upon RNAse activity.

Another mode of colorimetric readout involves nucleic acid substrates that change color upon cleavage. Witmer (1991) utilized a synthetic ribonucleotide substrate, U-3'-BCIP, that releases a reporter group after cleavage, resulting in generation of absorbance at 650 nm.

Deaminase Functionalized CRISPR/Cas13

In certain aspects and embodiments of the invention, the Cas13 protein as described herein (including for instance Cas13a, Cas13b, or Cas13c, including any orthologue such as those described herein elsewhere), including any Cas13 protein variant (such as functional variants, mutants (including but not limited to catalytically inactive mutants), (functional) domains or truncations (including split Cas13), Cas13 fusion proteins (e.g. comprising NLS or NES sequences or any other fusion proteins described herein elsewhere, etc) as described herein may be covalently or non-covalently associated or fused to a deaminase or a functional fragment thereof, such as a catalytically active fragment thereof. The deaminase may be an adenosine deaminase or a cytidine deaminase, preferably which deaminase is an RNA specific deaminase. The deaminase as described herein may be a truncated or mutated deaminase. It will be understood that whenever reference is made herein to adenosine deaminase, similar considerations apply to cytidine deaminase (and instead of deaminating adenine, cytidine is deaminated).

In certain aspects and embodiments, the invention relates to polynucleic acids encoding such Cas13-deaminase fusion proteins, which may advantageously be codon-optimized (or encoding separately Cas13 and deaminase in case of non-covalent linkage), as well as vectors and vector systems for propagation and/or expression, such as prokaryotic or eukaryotic propagation or expression. Exemplary polynucleic acids, and vectors are described herein elsewhere.

In certain aspects and embodiments, the invention relates to host cells (or progeny thereof), organs, or organisms (or off-spring thereof) comprising the proteins and/or polynucleotides or vectors or vector systems described above. Exemplary host cells/organs/organisms, as well as expression systems are described herein elsewhere.

In certain aspects and embodiments, the invention relates to systems, complexes, or compositions (including kits), such as pharmaceutical compositions, comprising such proteins, polynucleic acids, vectors or vector systems, host cells, organs, or organisms. Exemplary systems, complexes, or compositions, such as pharmaceutical compositions are described herein elsewhere. It will be understood that such systems, complexes, or compositions may further include a guide RNA, as described herein elsewhere, including any variant guide RNA (such as escorted, protected, dead guides, etc., including guided comprising aptamers).

In certain aspects and embodiments, the invention relates to uses of or methods involving the use of such proteins, polynucleic acids, vectors or vector systems, host cells, organs, organisms, systems, complexes, or compositions. Exemplary methods and uses are described herein elsewhere. In particular embodiments, the uses and methods involve modifying an Adenine or cytidine in a target RNA sequence of interest. In particular embodiments, the uses or methods are therapeutic or prophylactic, as also described herein elsewhere. Advantageously, the uses and methods may involve targeted base editing. In one aspect, the invention described herein provides methods for modifying an adenosine residue at a target locus with the aim of remedying and/or preventing a diseased condition that is or is likely to be caused by a G-to-A or C-to-T point mutation or a pathogenic single nucleotide polymorphism (SNP). Pathogenic G-to-A or C-to-T mutations/SNPs associated with various diseases affecting the brain and central nervous system are reported in the ClinVar database. According to the present invention, any of the mutations/SNPs can be targeted.

In general, the systems disclosed herein comprise a targeting component and a base editing component. The targeting component functions to specifically target the base editing component to a target nucleotide sequence in which one or more nucleotides are to be edited. The base editing component may then catalyze a chemical reaction to convert a first nucleotide in the target sequence to a second nucleotide. For example, the base editor may catalyze conversion of an adenine such that it is read as guanine by a cell's transcription or translation machinery, or vice versa. Likewise, the base editing component may catalyze conversion of cytidine to uracil, or vice versa. In certain example embodiments, the base editor may be derived by starting with a known base editor, such as an adenine deaminase or cytodine deaminase, and modified using methods such as directed evolution to derive new functionalities. Directed evolution techniques are known in the art and may include those described in WO 2015/184016 "High-Throughput Assembly of Genetic Permuatations."

In an aspect, the invention relates to a (fusion) protein or protein complex, or (a) polynucleotide(s) (including vectors and vector systems) encoding such, comprising (a) a catalytically inactive (dead) Cas13 protein; and (b) an (adenosine) deaminase protein or catalytic domain thereof, wherein said (adenosine) deaminase protein or catalytic domain thereof is covalently or non-covalently linked to said dead Cas13 protein or is adapted to link thereto after delivery. In certain embodiments, the (fusion) protein or protein complex can bind or is adapted to bind to a guide molecule which comprises a guide sequence linked to a direct repeat sequence; wherein guide molecule forms a complex with said dead Cas13 protein and directs said complex to bind said target RNA sequence of interest, wherein said guide sequence is capable of hybridizing with a target sequence comprising said Adenine to form an RNA duplex, wherein said guide sequence comprises a non-pairing Cytosine at a position corresponding to said Adenine resulting in an A-C mismatch in the RNA duplex formed; wherein said (adenosine) deaminase protein or catalytic domain thereof deaminates said Adenine in said RNA duplex.

In an aspect, the invention relates to a composition, complex, or system comprising (a) a catalytically inactive (dead) Cas13 protein; (b) a guide molecule which comprises a guide sequence linked to a direct repeat sequence; and (c) an (adenosine) deaminase protein or catalytic domain thereof; wherein said (adenosine) deaminase protein or catalytic domain thereof is covalently or non-covalently linked to said dead Cas13 protein or said guide molecule or is adapted to link thereto after delivery; wherein guide molecule forms a complex with said dead Cas13 protein and directs said complex to bind said target RNA sequence of interest, wherein said guide sequence is capable of hybridizing with a target sequence comprising said Adenine to form an RNA duplex, wherein said guide sequence comprises a non-pairing Cytosine at a position corresponding to said Adenine resulting in an A-C mismatch in the RNA duplex formed; wherein said (adenosine) deaminase protein or catalytic domain thereof deaminates said Adenine in said RNA duplex. The invention additionally relates to an engineered, non-naturally occurring (vector) system suitable for modifying an Adenine in a target locus of interest, comprising: a guide molecule which comprises a guide sequence, or a nucleotide sequence encoding the guide molecule; a CRISPR-Cas protein, or one or more nucleotide sequences encoding the CRISPR-Cas protein; an (adenosine) deaminase protein or catalytic domain thereof, or one or more nucleotide sequences encoding; wherein the (adenosine) deaminase protein or catalytic domain thereof is covalently or non-covalently linked to the CRISPR-Cas protein or the guide molecule or is adapted to link thereto after delivery; wherein the guide sequence is capable of hybridizing with a target sequence comprising an Adenine within an RNA polynucleotide of interest, but comprises a Cytosine at the position corresponding to the Adenine.

In an aspect, the invention relates to an engineered, non-naturally occurring vector system suitable for modifying an Adenine in a target locus of interest, comprising one or more vectors comprising: (a) a first regulatory element operably linked to a nucleotide sequence encoding said guide molecule which comprises said guide sequence, (b) a second regulatory element operably linked to a nucleotide sequence encoding said catalytically inactive Cas13 protein; and (c) a nucleotide sequence encoding an (adenosine) deaminase protein or catalytic domain thereof which is under control of said first or second regulatory element or operably linked to a third regulatory element; wherein, if said nucleotide sequence encoding an (adenosine) deaminase protein or catalytic domain thereof is operably linked to a third regulatory element, said (adenosine) deaminase protein or catalytic domain thereof is adapted to link to said guide molecule or said Cas13 protein after expression; wherein components (a), (b) and (c) are located on the same or different vectors of the system.

In an aspect, the invention relates to a method of modifying an Adenine in a target RNA sequence of interest. In particular embodiments, the method comprises delivering to said target RNA: (a) a catalytically inactive (dead) Cas13 protein; (b) a guide molecule which comprises a guide sequence linked to a direct repeat sequence; and (c) an (adenosine) deaminase protein or catalytic domain thereof; wherein said (adenosine) deaminase protein or catalytic domain thereof is covalently or non-covalently linked to said dead Cas13 protein or said guide molecule or is adapted to link thereto after delivery; wherein guide molecule forms a complex with said dead Cas13 protein and directs said complex to bind said target RNA sequence of interest, wherein said guide sequence is capable of hybridizing with a target sequence comprising said Adenine to form an RNA duplex, wherein said guide sequence comprises a non-pairing Cytosine at a position corresponding to said Adenine resulting in an A-C mismatch in the RNA duplex formed; wherein said (adenosine) deaminase protein or catalytic domain thereof deaminates said Adenine in said RNA duplex.

The invention further relates to a method for cell therapy, comprising administering to a patient in need thereof the modified cell described herein, wherein the presence of the modified cell remedies a disease in the patient. In one embodiment, the modified cell for cell therapy is a CAR-T cell capable of recognizing and/or attacking a tumor cell. In another embodiment, the modified cell for cell therapy is a stem cell, such as a neural stem cell, a mesenchymal stem cell, a hematopoietic stem cell, or an iPSC cell.

The invention also relates to a method for knocking-out or knocking-down an undesirable activity of a gene, wherein the deamination of the A at the transcript of the gene results in a loss of function. For example, in one embodiment, the targeted deamination by the deaminase-functionalized CRISPR system can cause a nonsense mutation resulting in a premature stop codon in an endogenous gene. This may alter the expression of the endogenous gene and can lead to a desirable trait in the edited cell. In another embodiment, the targeted deamination by the deaminase-functionalized CRISPR system can cause a non-conservative missense mutation resulting in a code for a different amino acid residue in an endogenous gene. This may alter the function of the endogenous gene expressed and can also lead to a desirable trait in the edited cell.

The deaminase-functionalized CRISPR system described herein can be used to target a specific Adenine within an RNA polynucleotide sequence for deamination. For example, the guide molecule can form a complex with the CRISPR-Cas protein and directs the complex to bind a target RNA sequence in the RNA polynucleotide of interest. Because the guide sequence is designed to have a non-pairing C, the RNA duplex formed between the guide sequence and the target sequence comprises an A-C mismatch, which directs the (adenosine) deaminase to contact and deaminate the A opposite to the non-pairing C, converting it to Inosine (I). Since Inosine (I) base pairs with C and functions like G in cellular process, the targeted deamination of A described herein are useful for correction of undesirable G-A and C-T mutations, as well as for obtaining desirable A-G and T-C mutations.

In certain example embodiments, the Cas13 protein is Cas13a, Cas13b or Cas 13c.

The (adenosine) deaminase protein or catalytic domain thereof may be fused to N- or C-terminus of said dead Cas13 protein. In certain example embodiments, the (adenosine) deaminase protein or catalytic domain thereof is fused to said dead Cas13 protein by a linker. The linker may be $(GGGGS)_{3-11}$ (SEQ ID NOS: 138-143), $GSG_5$ (SEQ ID NO: 144) or LEPGEKPYKCPECGKSFSQSGALTRHQRTHTR (SEQ ID NO: 145).

In certain example embodiments, the (adenosine) deaminase protein or catalytic domain thereof is linked to an adaptor protein and said guide molecule or said dead Cas13 protein comprises an aptamer sequence capable of binding to said adaptor protein. The adaptor sequence may be selected from MS2, PP7, QP, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1.

In certain example embodiments, the (adenosine) deaminase protein or catalytic domain thereof is inserted into an internal loop of said dead Cas13 protein. In certain example embodiments, the Cas13a protein comprises one or more mutations in the two HEPN domains, particularly at position R474 and R1046 of Cas 13a protein originating from *Leptotrichia wadei* or amino acid positions corresponding thereto of a Cas13a ortholog.

In certain example embodiments, the Cas 13 protein is a Cas13b proteins, and the Cas13b comprises a mutation in one or more of positions R116, H121, R1177, H1182 of Cas13b protein originating from *Bergeyella zoohelcum* ATCC 43767 or amino acid positions corresponding thereto of a Cas13b ortholog. In certain other example embodiments, the mutation is one or more of R116A, H121A, R1177A, H1182A of Cas13b protein originating from *Bergeyella zoohelcum* ATCC 43767 or amino acid positions corresponding thereto of a Cas13b ortholog.

In certain example embodiments, the guide sequence has a length of about 29-53 nt capable of forming said RNA duplex with said target sequence. In certain other example embodiments, the guide sequence has a length of about 40-50 nt capable of forming said RNA duplex with said target sequence. In certain example embodiments, the distance between said non-pairing C and the 5' end of said guide sequence is 20-30 nucleotides.

In certain example embodiments, the (adenosine) deaminase protein or catalytic domain thereof is a human, cephalopod, or *Drosophila* (adenosine) deaminase protein or catalytic domain thereof. In certain example embodiments, the (adenosine) deaminase protein or catalytic domain thereof has been modified to comprise a mutation at glutamic acid$^{488}$ of the hADAR2-D amino acid sequence, or a corresponding position in a homologous ADAR protein. In certain example embodiments, the glutamic acid residue may be at position 488 or a corresponding position in a homologous ADAR protein is replaced by a glutamine residue (E488Q).

In certain other example embodiments, the (adenosine) deaminase protein or catalytic domain thereof is a mutated hADAR2d comprising mutation E488Q or a mutated hADAR1d comprising mutation E1008Q.

In certain example embodiments, the guide sequence comprises more than one mismatch corresponding to different adenosine sites in the target RNA sequence or wherein two guide molecules are used, each comprising a mismatch corresponding to a different adenosine site in the target RNA sequence.

In certain example embodiments, the Cas13 protein and optionally said (adenosine) deaminase protein or catalytic domain thereof comprise one or more heterologous nuclear localization signal(s) (NLS(s)).

In certain example embodiments, the method further comprises determining the target sequence of interest and selecting an (adenosine) deaminase protein or catalytic domain thereof which most efficiently deaminates said Adenine present in then target sequence.

The target RNA sequence of interest may be within a cell. The cell may be a eukaryotic cell, a non-human animal cell, a human cell, a plant cell. The target locus of interest may be within an animal or plant.

The target RNA sequence of interest may comprise in an RNA polynucleotide in vitro.

The components of the systems described herein may be delivered to said cell as a ribonucleoprotein complex or as one or more polynucleotide molecules, or any other delivery method as described herein elsewhere, including viral or non-viral delivery. The one or more polynucleotide molecules may comprise one or more mRNA molecules encoding the components. The one or more polynucleotide molecules may be comprised within one or more vectors. The one or more polynucleotide molecules may further comprise one or more regulatory elements operably configured to express said Cas13 protein, said guide molecule, and said deaminase protein or catalytic domain thereof, optionally wherein said one or more regulatory elements comprise inducible promoters. The one or more polynucleotide molecules or said ribonucleoprotein complex may be delivered via particles, vesicles, or one or more viral vectors. The particles may comprise a lipid, a sugar, a metal or a protein. The particles may comprise lipid nanoparticles. The vesicles may comprise exosomes or liposomes. The one or more viral vectors may comprise one or more of adenovirus, one or more lentivirus or one or more adeno-associated virus.

The methods disclosed herein may be used to modify a cell, a cell line, or an organism by manipulation of one or more target RNA sequences.

In certain example embodiments, the deamination of said Adenine in said target RNA of interest remedies a disease caused by transcripts containing a pathogenic G→A or C→T point mutation.

The methods maybe used to treat or prevent a disease, or otherwise alleviate a disease or the severity of a disease, such as in particular by the targeted deamination using the deaminase-functionalized CRISPR system, wherein the deamination of the A, which remedies a disease caused by transcripts containing a pathogenic G→A or C→T point mutation. In certain example embodiments, the disease is selected from Meier-Gorlin syndrome, Seckel syndrome 4, Joubert syndrome 5, Leber congenital amaurosis 10; Charcot-Marie-Tooth disease, type 2; Charcot-Marie-Tooth disease, type 2; Usher syndrome, type 2C; Spinocerebellar ataxia 28; Spinocerebellar ataxia 28; Spinocerebellar ataxia 28; Long QT syndrome 2; Sjögren-Larsson syndrome; Hereditary fructosuria; Hereditary fructosuria; Neuroblastoma; Neuroblastoma; Kallmann syndrome 1; Kallmann syndrome 1; Kallmann syndrome 1; Metachromatic leukodystrophy, Rett syndrome, Amyotrophic lateral sclerosis type 10, Li-Fraumeni syndrome. The disease may be a premature termination disease.

The methods disclosed herein, may be used to make a modification that affects the fertility of an organism. The modification may affect splicing of said target RNA sequence. The modification may introduce a mutation in a transcript introducing an amino acid change and causing expression of a new antigen in a cancer cell.

In certain example embodiments, the target RNA may be a microRNA or comprised within a microRNA. In certain example embodiments, the deamination of said Adenine in said target RNA of interest causes a gain of function or a loss of function of a gene. In certain example embodiments, the gene is a gene expressed by a cancer cell.

In another aspect, the invention comprises a modified cell or progeny thereof that is obtained using the methods disclosed herein, wherein said cell comprises a hypoxanthine or a guanine in replace of said Adenine in said target RNA of interest compared to a corresponding cell not subjected to the method. The modified cell or progeny thereof may be a eukaryotic cell an animal cell, a human cell, a therapeutic T cell, an antibody-producing B cell, a plant cell.

In another aspect, the invention comprises a non-human animal comprising said modified cell or progeny thereof. The modified may be a plant cell.

In another aspect, the invention comprises a method for cell therapy, comprising administering to a patient in need thereof the modified cells disclosed herein, wherein the presence of said modified cell remedies a disease in the patient.

In another aspect, the invention is directed to an engineered, non-naturally occurring system suitable for modifying an Adenine in a target locus of interest, comprising A) a guide molecule which comprises a guide sequence linked to a direct repeat sequence, or a nucleotide sequence encoding said guide molecule; B) a catalytically inactive Cas13 protein, or a nucleotide sequence encoding said catalytically inactive Cas13 protein; C) an (adenosine) deaminase protein or catalytic domain thereof, or a nucleotide sequence encoding said (adenosine) deaminase protein or catalytic domain thereof; wherein said (adenosine) deaminase protein or catalytic domain thereof is covalently or non-covalently linked to said Cas13 protein or said guide molecule or is adapted to link thereto after delivery; wherein said guide sequence is capable of hybridizing with a target RNA sequence comprising an Adenine to form an RNA duplex, wherein said guide sequence comprises a non-pairing Cytosine at a position corresponding to said Adenine resulting in an A-C mismatch in the RNA duplex formed.

In another aspect, the invention is directed to an engineered, non-naturally occurring vector system suitable for modifying an Adenine in a target locus of interest, comprising the nucleotide sequences of a), b), and c).

In another aspect, the invention is directed to an engineered, non-naturally occurring vector system, comprising one or more vectors comprising: a first regulatory element operably linked to a nucleotide sequence encoding said guide molecule which comprises said guide sequence, a second regulatory element operably linked to a nucleotide sequence encoding said catalytically inactive Cas13 protein; and a nucleotide sequence encoding an (adenosine) deaminase protein or catalytic domain thereof which is under control of said first or second regulatory element or operably linked to a third regulatory element; wherein, if said nucleotide sequence encoding an (adenosine) deaminase protein or catalytic domain thereof is operably linked to a third regulatory element, said (adenosine) deaminase protein or catalytic domain thereof is adapted to link to said guide molecule or said Cas13 protein after expression; wherein components A), B), and C) are located on the same or different vectors of the system.

In another aspect, the invention is directed to in vitro, or ex vivo host cell or progeny thereof or cell line or progeny thereof comprising the systems disclosed herein. The host cell or progeny thereof may be a eukaryotic cell, an animal cell, a human cell, or a plant cell.

In one aspect of the present invention provides methods for targeted deamination of adenine in RNA, more particularly in an RNA sequence of interest. According to the methods of the invention, the (adenosine) deaminase (AD) protein is recruited specifically to the relevant Adenine in the RNA sequence of interest by a CRISPR-Cas complex which can specifically bind to a target sequence. In order to achieve this, the (adenosine) deaminase protein can either be covalently linked to the CRISPR-Cas enzyme or be provided as a separate protein but adapted so as to ensure recruitment thereof to the CRISPR-Cas complex.

In particular embodiments, of the methods of the present invention, recruitment of the (adenosine) deaminase to the target locus is ensured by fusing the (adenosine) deaminase or catalytic domain thereof to the CRISPR-Cas protein, which is a Cas13 protein. Methods of generating a fusion protein from two separate proteins are known in the art and typically involve the use of spacers or linkers. The Cas13 protein can be fused to the (adenosine) deaminase protein or catalytic domain thereof on either the N- or C-terminal end thereof. In particular embodiments, the CRISPR-Cas protein is an inactive or dead Cas13 protein and is linked to the N-terminus of the deaminase protein or its catalytic domain.

The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

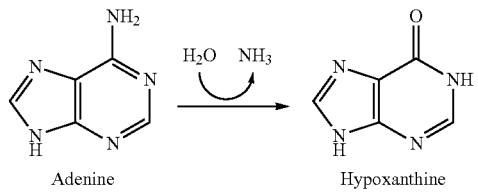

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. In particular embodiments, the adenosine deaminase has been modified to increase its ability to edit DNA in an RNA/DNA and RNA duplex as detailed herein below.

In some embodiments, the adenosine deaminase is derived from one or more metazoa species, including but not limited to, mammals, birds, frogs, squids, fish, flies, and worms. In some embodiments, the adenosine deaminase is a human, squid, or *Drosophila* adenosine deaminase.

In some embodiments, the adenosine deaminase is a human ADAR, including hADAR1, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid *Loligo pealeii* ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TENR (hADAD1) and TENRL (hADAD2).

In some embodiments, the adenosine deaminase protein recognizes and converts one or more target adenosine residue(s) in a double-stranded nucleic acid substrate into inosine residues (s). In some embodiments, the double-stranded nucleic acid substrate is an RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the adenosine deaminase protein comprises one or more deaminase domains. Not intended to be bound by theory, it is contemplated that the deaminase domain functions to recognize and convert one or more target adenosine (A) residue(s) contained in a double-stranded nucleic acid substrate into inosine (I) residues (s). In some embodiments, the deaminase domain comprises an active center. In some embodiments, the active center comprises a zinc ion. In some embodiments, during the A-to-I editing process, base pairing at the target adenosine residue is disrupted, and the target adenosine residue is "flipped" out of the double helix to become accessible by the adenosine deaminase. In some embodiments, amino acid residues in or near the active center interact with one or more nucleotide(s) 5' to a target adenosine residue. In some embodiments, amino acid residues in or near the active center interact with one or more nucleotide(s) 3' to a target adenosine residue. In some embodiments, amino acid residues in or near the active center further interact with the nucleotide complementary to the target adenosine residue on the opposite strand. In some embodiments, the amino acid residues form hydrogen bonds with the 2' hydroxyl group of the nucleotides.

In some embodiments, the adenosine deaminase comprises human ADAR2 full protein (hADAR2) or the deaminase domain thereof (hADAR2-D). In some embodiments, the adenosine deaminase is an ADAR family member that is homologous to hADAR2 or hADAR2-D.

Particularly, in some embodiments, the homologous ADAR protein is human ADAR1 (hADAR1) or the deaminase domain thereof (hADAR1-D). In some embodiments, glycine 1007 of hADAR1-D corresponds to glycine 487 hADAR2-D, and glutamic Acid 1008 of hADAR1-D corresponds to glutamic acid 488 of hADAR2-D.

In some embodiments, the adenosine deaminase comprises the wild-type amino acid sequence of hADAR2-D. In some embodiments, the adenosine deaminase comprises one or more mutations in the hADAR2-D sequence, such that the editing efficiency, and/or substrate editing preference of hADAR2-D is changed according to specific needs.

Certain mutations of hADAR1 and hADAR2 proteins have been described in Kuttan et al., Proc Natl Acad Sci USA. (2012) 109(48):E3295-304; Want et al. ACS Chem Biol. (2015) 10(11):2512-9; and Zheng et al. Nucleic Acids Res. (2017) 45(6):3369-337, each of which is incorporated herein by reference in its entirety.

In some embodiments, the adenosine deaminase comprises a mutation at glycine336 of the hADAR2-D amino acid sequence, or a corresponding position in a homologous ADAR protein. In some embodiments, the glycine residue at position 336 is replaced by an aspartic acid residue (G336D).

In some embodiments, the adenosine deaminase comprises a mutation at Glycine487 of the hADAR2-D amino acid sequence, or a corresponding position in a homologous ADAR protein. In some embodiments, the glycine residue at position 487 is replaced by a non-polar amino acid residue with relatively small side chains. For example, in some embodiments, the glycine residue at position 487 is replaced by an alanine residue (G487A). In some embodiments, the glycine residue at position 487 is replaced by a valine residue (G487V). In some embodiments, the glycine residue at position 487 is replaced by an amino acid residue with relatively large side chains. In some embodiments, the glycine residue at position 487 is replaced by an arginine residue (G487R). In some embodiments, the glycine residue at position 487 is replaced by a lysine residue (G487K). In some embodiments, the glycine residue at position 487 is replaced by a tryptophan residue (G487W). In some embodiments, the glycine residue at position 487 is replaced by a tyrosine residue (G487Y).

In some embodiments, the adenosine deaminase comprises a mutation at glutamic acid488 of the hADAR2-D amino acid sequence, or a corresponding position in a homologous ADAR protein. In some embodiments, the glutamic acid residue at position 488 is replaced by a glutamine residue (E488Q). In some embodiments, the glutamic acid residue at position 488 is replaced by a histidine residue (E488H). In some embodiments, the glutamic acid residue at position 488 is replace by an arginine residue (E488R). In some embodiments, the glutamic acid residue at position 488 is replace by a lysine residue (E488K). In some embodiments, the glutamic acid residue at position 488 is replace by an asparagine residue (E488N). In some embodiments, the glutamic acid residue at position 488 is replace by an alanine residue (E488A). In some embodiments, the glutamic acid residue at position 488 is replace by a Methionine residue (E488M). In some embodiments, the glutamic acid residue at position 488 is replace by a serine residue (E488S). In some embodiments, the glutamic acid residue at position 488 is replace by a phenylalanine residue (E488F). In some embodiments, the glutamic acid residue at position 488 is replace by a lysine residue (E488L). In some embodiments, the glutamic acid residue at position 488 is replace by a tryptophan residue (E488W).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by a cysteine residue (T490C). In some embodiments, the threonine residue at position 490 is replaced by a serine residue (T490S). In some embodiments, the threonine residue at position 490 is replaced by an alanine residue (T490A). In some embodiments, the threonine residue at position 490 is replaced by a phenylalanine residue (T490F). In some embodiments, the threonine residue at position 490 is replaced by a tyrosine residue (T490Y). In some embodiments, the threonine residue at position 490 is replaced by a serine residue (T490R). In some embodiments, the threonine residue at position 490 is replaced by an alanine residue (T490K). In some embodiments, the threonine residue at position 490 is replaced by a phenylalanine residue (T490P). In some embodiments, the threonine residue at position 490 is replaced by a tyrosine residue (T490E).

In some embodiments, the adenosine deaminase comprises a mutation at valine493 of the hADAR2-D amino acid sequence, or a corresponding position in a homologous ADAR protein. In some embodiments, the valine residue at position 493 is replaced by an alanine residue (V493A). In some embodiments, the valine residue at position 493 is replaced by a serine residue (V493S). In some embodiments, the valine residue at position 493 is replaced by a threonine residue (V493T). In some embodiments, the valine residue at position 493 is replaced by an arginine residue (V493R). In some embodiments, the valine residue at position 493 is replaced by an aspartic acid residue (V493D). In some embodiments, the valine residue at position 493 is replaced by a proline residue (V493P). In some embodiments, the valine residue at position 493 is replaced by a glycine residue (V493G).

In some embodiments, the adenosine deaminase comprises a mutation at alanine589 of the hADAR2-D amino acid sequence, or a corresponding position in a homologous ADAR protein. In some embodiments, the alanine residue at position 589 is replaced by a valine residue (A589V).

In some embodiments, the adenosine deaminase comprises a mutation at asparagine597 of the hADAR2-D amino acid sequence, or a corresponding position in a homologous ADAR protein. In some embodiments, the asparagine residue at position 597 is replaced by a lysine residue (N597K). In some embodiments, the adenosine deaminase comprises a mutation at position 597 of the amino acid sequence, which has an asparagine residue in the wildtype sequence. In some embodiments, the asparagine residue at position 597 is replaced by an arginine residue (N597R). In some embodiments, the adenosine deaminase comprises a mutation at position 597 of the amino acid sequence, which has an asparagine residue in the wildtype sequence. In some embodiments, the asparagine residue at position 597 is replaced by an alanine residue (N597A). In some embodiments, the adenosine deaminase comprises a mutation at position 597 of the amino acid sequence, which has an asparagine residue in the wildtype sequence. In some embodiments, the asparagine residue at position 597 is replaced by a glutamic acid residue (N597E). In some embodiments, the adenosine deaminase comprises a mutation at position 597 of the amino acid sequence, which has an asparagine residue in the wildtype sequence. In some embodiments, the asparagine residue at position 597 is replaced by a histidine residue (N597H). In some embodiments, the adenosine deaminase comprises a mutation at position 597 of the amino acid sequence, which has an asparagine residue in the wildtype sequence. In some embodiments, the asparagine residue at position 597 is replaced by a glycine residue (N597G). In some embodiments, the adenosine deaminase comprises a mutation at position 597 of the amino acid sequence, which has an asparagine residue in the wildtype sequence. In some embodiments, the asparagine residue at position 597 is replaced by a tyrosine residue (N597Y). In some embodiments, the asparagine residue at position 597 is replaced by a phenylalanine residue (N597F).

In some embodiments, the adenosine deaminase comprises a mutation at serine599 of the hADAR2-D amino acid sequence, or a corresponding position in a homologous ADAR protein. In some embodiments, the serine residue at position 599 is replaced by a threonine residue (S599T).

In some embodiments, the adenosine deaminase comprises a mutation at asparagine613 of the hADAR2-D amino acid sequence, or a corresponding position in a homologous ADAR protein. In some embodiments, the asparagine residue at position 613 is replaced by a lysine residue (N613K). In some embodiments, the adenosine deaminase comprises a mutation at position 613 of the amino acid sequence, which has an asparagine residue in the wildtype sequence. In some embodiments, the asparagine residue at position 613 is replaced by an arginine residue (N613R). In some embodiments, the adenosine deaminase comprises a mutation at position 613 of the amino acid sequence, which has an asparagine residue in the wildtype sequence. In some embodiments, the asparagine residue at position 613 is replaced by an alanine residue (N613A) In some embodiments, the adenosine deaminase comprises a mutation at position 613 of the amino acid sequence, which has an asparagine residue in the wildtype sequence. In some embodiments, the asparagine residue at position 613 is replaced by a glutamic acid residue (N613E).

In some embodiments, to improve editing efficiency, the adenosine deaminase may comprise one or more of the mutations: G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E, based on amino acid sequence positions of hADAR2-D, and mutations in a homologous ADAR protein corresponding to the above.

In some embodiments, to reduce editing efficiency, the adenosine deaminase may comprise one or more of the mutations: E488F, E488L, E488W, T490A, T490F, T490Y, T490R, T490K, T490P, T490E, N597F, based on amino acid sequence positions of hADAR2-D, and mutations in a homologous ADAR protein corresponding to the above. In particular embodiments, it can be of interest to use an adenosine deaminase enzyme with reduced efficicay to reduce off-target effects.

In certain embodiments, improvement of editing and reduction of off-target modification is achieved by chemical modification of gRNAs. gRNAs which are chemically modified as exemplified in Vogel et al. (2014), Angew Chem Int Ed, 53:6267-6271, doi:10.1002/anie.201402634 (incorporated herein by reference in its entirety) reduce off-target activity and improve on-target efficiency. 2'-O-methyl and phosphorothioate modified guide RNAs in general improve editing efficiency in cells.

ADAR has been known to demonstrate a preference for neighboring nucleotides on either side of the edited A (www.nature.com/nsmb/journal/v23/n5/full/nsmb.3203.html, Matthews et al. (2017), Nature Structural Mol Biol, 23(5): 426-433, incorporated herein by reference in its entirety). Accordingly, in certain embodiments, the gRNA, target, and/or ADAR is selected optimized for motif preference.

Intentional mismatches have been demonstrated in vitro to allow for editing of non-preferred motifs (academic.oup.com/nar/article-lookup/doi/10.1093/nar/gku272; Schneider et al (2014), Nucleic Acid Res, 42(10):e87); Fukuda et al. (2017), Scienticic Reports, 7, doi:10.1038/srep41478, incorporated herein by reference in its entirety). Accordingly, in certain embodiments, to enhance RNA editing efficiency on non-preferred 5' or 3' neighboring bases, intentional mismatches in neighboring bases are introduced.

Results suggest that As opposite Cs in the targeting window of the ADAR deaminase domain are preferentially edited over other bases. Additionally, As base-paired with Us within a few bases of the targeted base show low levels of editing by Cas13b-ADAR fusions, suggesting that there is flexibility for the enzyme to edit multiple A's. See e.g. FIG. 18. These two observations suggest that multiple As in the activity window of Cas13b-ADAR fusions could be specified for editing by mismatching all As to be edited with Cs. Accordingly, in certain embodiments, multiple A:C mismatches in the activity window are designed to create multiple A:I edits. In certain embodiments, to suppress potential off-target editing in the activity window, non-target As are paired with As or Gs.

The terms "editing specificity" and "editing preference" are used interchangeably herein to refer to the extent of A-to-I editing at a particular adenosine site in a double-stranded substrate. In some embodiment, the substrate editing preference is determined by the 5' nearest neighbor and/or the 3' nearest neighbor of the target adenosine residue. In some embodiments, the adenosine deaminase has preference for the 5' nearest neighbor of the substrate ranked as U>A>C>G (">" indicates greater preference). In some embodiments, the adenosine deaminase has preference for the 3' nearest neighbor of the substrate ranked as G>C~A>U (">" indicates greater preference; "~" indicates similar preference). In some embodiments, the adenosine deaminase has preference for the 3' nearest neighbor of the substrate ranked as G>C>U~A (">" indicates greater preference; "~" indicates similar preference). In some embodiments, the adenosine deaminase has preference for the 3' nearest neighbor of the substrate ranked as G>C>A>U (">" indicates greater preference). In some embodiments, the adenosine deaminase has preference for the 3' nearest neighbor of the substrate ranked as C~G~A>U (">" indicates greater preference; "~" indicates similar preference). In some embodiments, the adenosine deaminase has preference for a triplet sequence containing the target adenosine residue ranked as TAG>AAG>CAC>AAT>GAA>GAC (">" indicates greater preference), the center A being the target adenosine residue.

In some embodiments, the substrate editing preference of an adenosine deaminase is affected by the presence or absence of a nucleic acid binding domain in the adenosine deaminase protein. In some embodiments, to modify substrate editing preference, the deaminase domain is connected with a double-strand RNA binding domain (dsRBD) or a double-strand RNA binding motif (dsRBM). In some embodiments, the dsRBD or dsRBM may be derived from an ADAR protein, such as hADAR1 or hADAR2. In some embodiments, a full-length ADAR protein that comprises at least one dsRBD and a deaminase domain is used. In some embodiments, the one or more dsRBM or dsRBD is at the N-terminus of the deaminase domain. In other embodiments, the one or more dsRBM or dsRBD is at the C-terminus of the deaminase domain.

In some embodiments, the substrate editing preference of an adenosine deaminase is affected by amino acid residues near or in the active center of the enzyme. In some embodiments, to modify substrate editing preference, the adenosine deaminase may comprise one or more of the mutations: G336D, G487R, G487K, G487W, G487Y, E488Q, E488N, T490A, V493A, V493T, V493S, N597K, N597R, A589V, S599T, N613K, N613R, based on amino acid sequence positions of hADAR2-D, and mutations in a homologous ADAR protein corresponding to the above.

Particularly, in some embodiments, to reduce editing specificity, the adenosine deaminase can comprise one or more of mutations E488Q, V493A, N597K, N613K, based on amino acid sequence positions of hADAR2-D, and mutations in a homologous ADAR protein corresponding to the above. In some embodiments, to increase editing specificity, the adenosine deaminase can comprise mutation T490A.

In some embodiments, to reduce off-target effects, the adenosine deaminase comprises one or more of mutations at R348, V351, T375, K376, E396, C451, R455, N473, R474, K475, R477, R481, S486, E488, T490, S495, R510, based on amino acid sequence positions of hADAR2-D, and mutations in a homologous ADAR protein corresponding to the above. In some embodiments, the adenosine deaminase comprises mutation at E488 and one or more additional positions selected from R348, V351, T375, K376, E396, C451, R455, N473, R474, K475, R477, R481, S486, T490, S495, R510. In some embodiments, the adenosine deaminase comprises mutation at T375, and optionally at one or more additional positions. In some embodiments, the adenosine deaminase comprises mutation at N473, and optionally at one or more additional positions. In some embodiments, the adenosine deaminase comprises mutation at V351, and optionally at one or more additional positions. In some embodiments, the adenosine deaminase comprises mutation at E488 and T375, and optionally at one or more additional positions. In some embodiments, the adenosine deaminase comprises mutation at E488 and N473, and optionally at one or more additional positions. In some embodiments, the adenosine deaminase comprises mutation E488 and V351, and optionally at one or more additional positions. In some embodiments, the adenosine deaminase comprises mutation at E488 and one or more of T375, N473, and V351.

In some embodiments, to reduce off-target effects, the adenosine deaminase comprises one or more of mutations selected from R348E, V351L, T375G, T375S, R455G, R455S, R455E, N473D, R474E, K475Q, R477E, R481E, S486T, E488Q, T490A, T490S, S495T, and R510E, based on amino acid sequence positions of hADAR2-D, and mutations in a homologous ADAR protein corresponding to the above. In some embodiments, the adenosine deaminase comprises mutation E488Q, and one or more additional mutations selected from R348E, V351L, T375G, T375S, R455G, R455S, R455E, N473D, R474E, K475Q, R477E, R481E, S486T, T490A, T490S, S495T, and R510E. In some embodiments, the adenosine deaminase comprises mutation T375G or T375S, and optionally one or more additional mutations. In some embodiments, the adenosine deaminase comprises mutation N473D, and optionally one or more additional mutations. In some embodiments, the adenosine deaminase comprises mutation V351L, and optionally one or more additional mutations. In some embodiments, the adenosine deaminase comprises mutation E488Q, and T375G or T375G, and optionally one or more additional mutations. In some embodiments, the adenosine deaminase comprises mutation E488Q and N473D, and optionally one or more additional mutations. In some embodiments, the adenosine deaminase comprises mutation E488Q and V351L, and optionally one or more additional mutations. In some embodiments, the adenosine deaminase comprises mutation E488Q and one or more of T375G/S, N473D and V351L.

In some embodiments, to increase editing preference for target adenosine (A) with an immediate 5' G, such as substrates comprising the triplet sequence GAC, the center A being the target adenosine residue, the adenosine deaminase can comprise one or more of mutations G336D, E488Q, E488N, V493T, V493 S, V493A, A589V, N597K, N597R, S599T, N613K, N613R, based on amino acid sequence positions of hADAR2-D, and mutations in a homologous ADAR protein corresponding to the above.

Particularly, in some embodiments, the adenosine deaminase comprises mutation E488Q or a corresponding mutation in a homologous ADAR protein for editing substrates comprising the following triplet sequences: GAC, GAA, GAU, GAG, CAU, AAU, UAC, the center A being the target adenosine residue.

In some embodiments, the adenosine deaminase comprises the wild-type amino acid sequence of hADAR1-D. In some embodiments, the adenosine deaminase comprises one or more mutations in the hADAR1-D sequence, such that the editing efficiency, and/or substrate editing preference of hADAR1-D is changed according to specific needs.

In some embodiments, the adenosine deaminase comprises a mutation at Glycine1007 of the hADAR1-D amino acid sequence, or a corresponding position in a homologous ADAR protein. In some embodiments, the glycine residue at position 1007 is replaced by a non-polar amino acid residue with relatively small side chains. For example, in some embodiments, the glycine residue at position 1007 is replaced by an alanine residue (G1007A). In some embodiments, the glycine residue at position 1007 is replaced by a valine residue (G1007V). In some embodiments, the glycine residue at position 1007 is replaced by an amino acid residue with relatively large side chains. In some embodiments, the glycine residue at position 1007 is replaced by an arginine residue (G1007R). In some embodiments, the glycine residue at position 1007 is replaced by a lysine residue (G1007K). In some embodiments, the glycine residue at position 1007 is replaced by a tryptophan residue (G1007W). In some embodiments, the glycine residue at position 1007 is replaced by a tyrosine residue (G1007Y). Additionally, in other embodiments, the glycine residue at position 1007 is replaced by a leucine residue (G1007L). In other embodiments, the glycine residue at position 1007 is replaced by a threonine residue (G1007T). In other embodiments, the glycine residue at position 1007 is replaced by a serine residue (G1007S).

In some embodiments, the adenosine deaminase comprises a mutation at glutamic acid1008 of the hADAR1-D amino acid sequence, or a corresponding position in a homologous ADAR protein. In some embodiments, the glutamic acid residue at position 1008 is replaced by a polar amino acid residue having a relatively large side chain. In some embodiments, the glutamic acid residue at position 1008 is replaced by a glutamine residue (E1008Q). In some embodiments, the glutamic acid residue at position 1008 is replaced by a histidine residue (E1008H). In some embodiments, the glutamic acid residue at position 1008 is replaced by an arginine residue (E1008R). In some embodiments, the glutamic acid residue at position 1008 is replaced by a lysine residue (E1008K). In some embodiments, the glutamic acid residue at position 1008 is replaced by a nonpolar or small polar amino acid residue. In some embodiments, the glutamic acid residue at position 1008 is replaced by a phenylalanine residue (E1008F). In some embodiments, the glutamic acid residue at position 1008 is replaced by a tryptophan residue (E1008W). In some embodiments, the glutamic acid residue at position 1008 is replaced by a glycine residue (E1008G). In some embodiments, the glutamic acid residue at position 1008 is replaced by an isoleucine residue (E1008I). In some embodiments, the glutamic acid residue at position 1008 is replaced by a valine residue (E1008V). In some embodiments, the glutamic acid residue at position 1008 is replaced by a proline residue (E1008P). In some embodiments, the glutamic acid residue at position 1008 is replaced by a serine residue (E1008S). In other embodiments, the glutamic acid residue at position 1008 is replaced by an asparagine residue (E1008N). In other embodiments, the glutamic acid residue at position 1008 is replaced by an alanine residue (E1008A). In other embodiments, the glutamic acid residue at position 1008 is replaced by a Methionine residue (E1008M). In some embodiments, the glutamic acid residue at position 1008 is replaced by a leucine residue (E1008L).

In some embodiments, to improve editing efficiency, the adenosine deaminase may comprise one or more of the mutations: E1007S, E1007A, E1007V, E1008Q, E1008R, E1008H, E1008M, E1008N, E1008K, based on amino acid sequence positions of hADAR1-D, and mutations in a homologous ADAR protein corresponding to the above.

In some embodiments, to reduce editing efficiency, the adenosine deaminase may comprise one or more of the mutations: E1007R, E1007K, E1007Y, E1007L, E1007T, E1008G, E1008I, E1008P, E1008V, E1008F, E1008W, E1008S, E1008N, E1008K, based on amino acid sequence positions of hADAR1-D, and mutations in a homologous ADAR protein corresponding to the above.

In some embodiments, the substrate editing preference, efficiency and/or selectivity of an adenosine deaminase is affected by amino acid residues near or in the active center of the enzyme. In some embodiments, the adenosine deaminase comprises a mutation at the glutamic acid 1008 position in hADAR1-D sequence, or a corresponding position in a homologous ADAR protein. In some embodiments, the mutation is E1008R, or a corresponding mutation in a homologous ADAR protein. In some embodiments, the E1008R mutant has an increased editing efficiency for target adenosine residue that has a mismatched G residue on the opposite strand.

In some embodiments, the adenosine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the adenosine deaminase and the double-stranded substrate is mediated by one or more additional protein factor(s), including a CRISPR/CAS protein factor. In some embodiments, the interaction between the adenosine deaminase and the double-stranded substrate is further mediated by one or more nucleic acid component(s), including a guide RNA.

In certain example embodiments, directed evolution may be used to design modified ADAR proteins capable of catalyzing additional reactions besides deamination of a adenine to a hypoxanthine. For example According to the present invention, the substrate of the adenosine deaminase is an RNA/DNAn RNA duplex formed upon binding of the guide molecule to its DNA target which then forms the CRISPR-Cas complex with the CRISPR-Cas enzyme. The RNA/DNA or DNA/RNAn RNA duplex is also referred to herein as the "RNA/DNA hybrid", "DNA/RNA hybrid" or "double-stranded substrate". The particular features of the guide molecule and CRISPR-Cas enzyme are detailed below.

The term "editing selectivity" as used herein refers to the fraction of all sites on a double-stranded substrate that is edited by an adenosine deaminase. Without being bound by theory, it is contemplated that editing selectivity of an adenosine deaminase is affected by the double-stranded substrate's length and secondary structures, such as the presence of mismatched bases, bulges and/or internal loops.

In some embodiments, when the substrate is a perfectly base-paired duplex longer than 50 bp, the adenosine deaminase may be able to deaminate multiple adenosine residues within the duplex (e.g., 50% of all adenosine residues). In some embodiments, when the substrate is shorter than 50 bp, the editing selectivity of an adenosine deaminase is affected by the presence of a mismatch at the target adenosine site. Particularly, in some embodiments, adenosine (A) residue having a mismatched cytidine (C) residue on the opposite strand is deaminated with high efficiency. In some embodiments, adenosine (A) residue having a mismatched guanosine (G) residue on the opposite strand is skipped without editing.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 B1; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014 6/10/14; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, DEAD GUIDES FOR CRISPR TRANSCRIPTION FACTORS; U.S. application 62/091,456, 12 Dec. 2014, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOIETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, RNA-TARGETING SYSTEM; U.S. application 62/096,656, 24 Dec. 2014, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 2014, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN

VIVO MODELING AND GENETIC SCREENING OF TUMOR GROWTH AND METASTASIS.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, FA., Hsu, PD., Lin, CY., Gootenberg, J S., Konermann, S., Trevino, AE., Scott, DA., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, FA., Konermann, S., Agarwala, V., Li, Y., Fine, E., Wu, X., Shalem, O., Cradick, TJ., Marraffini, L A., Bao, G., & Zhang, F. Nat Biotechnol doi:10.1038/nbt.2647 (2013);

Genome engineering using the CRISPR-Cas9 system. Ran, FA., Hsu, PD., Wright, J., Agarwala, V., Scott, DA., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, DA., Mikkelson, T., Heckl, D., Ebert, BL., Root, D E., Doench, JG., Zhang, F. Science December 12. (2013). [Epub ahead of print];

Crystal structure of cas9 in complex with guide RNA and target DNA. Nishimasu, H., Ran, FA., Hsu, PD., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517(7536):583-8 (2015);

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse);

In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015);

Shalem et al., "High-throughput functional genomics using CRISPR-Cas9," Nature Reviews Genetics 16, 299-311 (May 2015);

Xu et al., "Sequence determinants of improved CRISPR sgRNA design," Genome Research 25, 1147-1157 (August 2015);

Parnas et al., "A Genome-wide CRISPR Screen in Primary Immune Cells to Dissect Regulatory Networks," *Cell* 162, 675-686 (Jul. 30, 2015);

Ramanan et al., CRISPR/Cas9 cleavage of viral DNA efficiently suppresses hepatitis B virus," Scientific Reports 5:10833. doi: 10.1038/srep10833 (Jun. 2, 2015);

Nishimasu et al., "Crystal Structure of *Staphylococcus aureus* Cas9," *Cell* 162, 1113-1126 (Aug. 27, 2015);

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015;

Shmakov et al. (2015), "Discovery and Functional Characterization of Diverse Class 2 CRISPR-Cas Systems," Molecular Cell 60, 385-397 (Nov. 5, 2015) doi: 10.1016/j.molcel.2015.10.008. Epub Oct. 22, 2015;

Dahlman et al., "Orthogonal gene control with a catalytically active Cas9 nuclease," Nature Biotechnology 33, 1159-1161 (November 2015);

Gao et al, "Engineered Cpf1 Enzymes with Altered PAM Specificities," bioRxiv 091611; doi: dx.doi.org/10.1101/091611 Epub Dec. 4, 2016; and Smargon et al. (2017), "Cas13b Is a Type VI-B CRISPR-Associated RNA-Guided RNase Differentially Regulated by Accessory Proteins Csx27 and Csx28," Molecular *Cell* 65, 618-630 (Feb. 16, 2017) doi: 10.1016/j.molcel.2016.12.023. Epub Jan. 5, 2017;

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors.

Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 Å resolution. The structure revealed a bilobed architecture composed of target recognition and nuclease lobes, accommodating the sgRNA:DNA heteroduplex in a positively charged groove at their interface. Whereas, the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Zetsche et al. (2015) reported the characterization of Cpf1, a putative class 2 CRISPR effector. It was demonstrated that Cpf1 mediates robust DNA interference with features distinct from Cas9. Identifying this mechanism of interference broadens our understanding of CRISPR-Cas systems and advances their genome editing applications.

Shmakov et al. (2015) reported the characterization of three distinct Class 2 CRISPR-Cas systems. The effectors of two of the identified systems, C2c1 and C2c3, contain RuvC like endonuclease domains distantly related to Cpf1. The third system, Cas13b, contains an effector with two predicted HEPN RNase domains.

Gao et al. (2016) reported using a structure-guided saturation mutagenesis screen to increase the targeting range of Cpf1. As Cpf1 variants were engineered with the mutations S542R/K607R and S542R/K548V/N552R that can cleave target sites with TYCV/CCCC and TATV PAMs, respectively, with enhanced activities in vitro and in human cells.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung *Nature* Biotechnology 32(6): 569-77 (2014), relates to dimeric RNA-guided FokI Nucleases that recognize extended sequences and can edit endogenous genes with high efficiencies in human cells.

In addition, mention is made of PCT application PCT/US14/70057, and BI-2013/107 entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_{1-6}$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP:DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

EXAMPLES

Example 1: Cas13b Orthologs

Cas13b proteins shown in Table 1 below are advantageously produced from constructs which are codon optimized for expression in mammalian cells. The sequences below are also given in FIG. 1, along with the accession number of the protein sequence. PFS motifs of the Cas13b orthologs are provided in Table 2.

TABLE 1

| | | |
|---|---|---|
| *Bergeyella zoohelcum* | 1 | MENKTSLGNNIYYNPFKPQDKSYFAGYFNAAMENTDSVFRELG KRLKGKEYTSENFFDAIFKENISLVEYERYVKLLSDYFPMARL LDKKEVPIKERKENFKKNFKGIIKAVRDLRNFYTHKEHGEVEI TDEIFGVLDEMLKSTVLTVKKKKVKTDKTKEILKKSIEKQLDI LCQKKLEYLRDTARKIEEKRRNQREREGEKELVAPFKYSDKRDD LIAAIYNDAFDVYIDKKKDSLKESSKAKYNTKSDPQQEEGDLK IPISKNGVVFLLSLFLTKQEIHAFKSKIAGFKATVIDEATVSE ATVSHGKNSICFMATHEIFSHLAYKKLKRKVRTAEINYGEAEN AEQLSVYAKETLMMQMLDELSKVPDVVYQNLSEDVQKTFIEDW NEYLKENNGDVGTMEEEQVIHPVIRKRYEDKFNYFAIRFLDEF AQFPTLRFQVEILGNYLHDSRPKENLISDRRIKEKITVFGRLS ELEHKKALFIKNTETNEDREHYWEIFPNPNYDFPKENISVNDK DFPIAGSILDREKQPVAGKIGIKVKLLNQQYVSEVDKAVKAHQ LKQRKASKPSIQNIIEEIVPINESNPKEAIVFGGQPTAYLSMN DIHSILYEFFDKWEKKKEKLEKKGEKELRKEIGKELEKKIVGK IQAQIQQIIDKDTNAKILKPYQDGNSTAIDKEKLIKDLKQEQN ILQKLKDEQTVREKEYNDFIAYQDKNREINKVRDRNHKQYLKD YNLKRKYPEAPARKEVLYREKGKVAVWLANDIKRFMPTDFKNE WKGEQHSLLQKSLAYYEQCKEELKNLLPEKVFQHLPFKLGGYF QQKYLYQFYTCYLDKRLEYISGLVQQAENFKSENKVFKKVENE CFKFLKKQNYTHKELDARVQSILGYPIFLERGFMDEKPTIIKG KTFKGNEALFADWFRYYKEYQNFQTFYDTENYPLVELEKKQAD RKRKTKIYQQKKNDVFTLLMAKHIFKSVFKQDSIDQFSLEDLY QSREERLGNQERARQTGERNTNYIWNKTVDLKLCDGKITVENV KLKNVGDFIKYEYDQRVQAFLKYEENIEWQAFLIKESKEEENY |

TABLE 1-continued

| | | |
|---|---|---|
| | | PYVVEREIEQYEKVRREELLKEVHLIEEYILEKVKDKEILKKG<br>DNQNFKYYILNGLLKQLKNEDVESYKVFNLNTEPEDVNINQLK<br>QEATDLEQKAFVLTYIRNKFAHNQLPKKEFWDYCQEKYGKIEK<br>EKTYAEYFAEVFKKEKEALIK |
| *Prevotella intermedia* | 2 | MEDDKKTTDSIRYELKDKHFWAAFLNLARHNVYITVNHINKIL<br>EEGEINRDGYETTLKNTWNEIKDINKKDRLSKLIIKHFPFLEA<br>ATYRLNPTDTTKQKEEKQAEAQSLESLRKSFFVFIYKLRDLRN<br>HYSHYKHSKSLERPKFEEGLLEKMYNIFNASIRLVKEDYQYNK<br>DINPDEDFKHLDRTEEEFNYYFTKDNEGNITESGLLFFVSLFL<br>EKKDAIWMQQKLRGFKDNRENKKKMTNEVFCRSRMLLPKLRLQ<br>STQTQDWILLDMLNELIRCPKSLYERLREEDREKFRVPIEIAD<br>EDYDAEQEPPFKNTLVRHQDRFPYFALRYFDYNEIFTNLRFQID<br>LGTYHFSTYKKQIGDYKESHHLTHKLYGFERIQEFTKQNRPDE<br>WRKFVKTFNSFETSKEPYIPETTPHYHLENQKIGIRFRNDNDK<br>IWPSLKTNSEKNEKSKYKLDKSFQAEAFLSVHELLPMMFYYLL<br>LKTENTDNDNEIETKKKENKNDKQEKHKIEEIIENKITEIYAL<br>YDTFANGEIKSIDELEEYCKGKDIEIGHLPKQMIAILKDEHKV<br>MATEAERKQEEMLVDVQKSLESLDNQINEEIENVERKNSSLKS<br>GKIASWLVNDMMRFQPVQKDNEGKPLNNSKANSTEYQLLQRTL<br>AFFGSEHERLAPYFKQTKLIESSNPHPFLKDTEWEKCNNILSF<br>YRSYLEAKKNFLESLKPEDWEKNQYFLKLKEPKTKPKTLVQGW<br>KNGFNLPRGIFTEPIRKWFMKHRENITVAELKRVGLVAKVIPL<br>FFSEEYKDSVQPFYNYHFNVGNINKPDEKNFLNCEERRELLRK<br>KKDEFKKMTDKEKEENPSYLEFKSWNKFERELRLVRNQDIVTW<br>LLCMELFNKKKIKELNVEKIYLKNINTNTTKKEKNTEEKNGEE<br>KNIKEKNNILNRIMPMRLPIKVYGRENFSKNKKKIRRNTFFT<br>VYIEEKGTKLLKQGNFKALERDRRLGGLFSFVKTPSKAESKSN<br>TISKLRVEYELGEYQKARIEIIKDMLALEKTLIDKYNSLDTDN<br>FNKMLTDWLELKGEPDKASFQNDVDLLIAVRNAFSHNQYPMRN<br>RIAFANINPFSLSSANTSEEKGLGIANQLKDKTHKTIEKIIEI<br>EKPIETKE |
| *Prevotella buccae* | 3 | MQKQDKLFVDRKKNAIFAFPKYITIMENKEKPEPIYYELTDKH<br>FWAAFLNLARHNVYTTINHINRRLEIAELKDDGYMMGIKGSWN<br>EQAKKLDKKVRLRDLIMKHFPFLEAAAYEMTNSKSPNNKEQRE<br>KEQSEALSLNNLKNVLFIFLEKLQVLRNYYSHYKYSEESPKPI<br>FETSLLKNMYKVFDANVRLVKRDYMHHENIDMQRDFTHLNRKK<br>QVGRTKNIIDSPNFHYHFADKEGNMTIAGLLFFVSLFLDKKDA<br>IWMQKKLKGFKDGRNLREQMTNEVFCRSRISLPKLKLENVQTK<br>DWMQLDMLNELVRCPKSLYERLREKDRESFKVPFDIFSDDYNA<br>EEEPFKNTLVRHQDRFPYFVLRYFDLNEIFEQLRFQIDLGTYH<br>FSIYNKRIGDEDEVRHLTHHLYGFARIQDFAPQNQPEEWRKLV<br>KDLDHFETSQEPYISKTAPHYHLENEKIGIKFCSAHNNLFPSL<br>QTDKTCNGRSKFNLGTQFTAEAFLSVHELLPMMFYYLLLTKDY<br>SRKESADKVEGIIRKEISNIYAIYDAFANNEINSIADLTRRLQ<br>NTNILQGHLPKQMISILKGRQKDMGKEAERKIGEMIDDTQRRL<br>DLLCKQTNQKIRIGKRNAGLLKSGKIADWLVNDMMRFQPVQKD<br>QNNIPINNSKANSTEYRMLQRALALFGSENFRLKAYFNQMNLV<br>GNDNPHPFLAETQWEHQTNILSFYRNYLEARKKYLKGLKPQNW<br>KQYQHFLILKVQKTNRNTLVTGWKNSFNLPRGIFTQPIREWFE<br>KHNNSKRIYDQILSFDRVGFVAKAIPLYFAEEYKDNVQPFYDY<br>PFNIGNRLKPKKRQFLDKKERVELWQKNKELFKNYPSEKKKTD<br>LAYLDFLSWKKFERELRLIKNQDIVTWLMFKELFNMATVEGLK<br>IGEIHLRDIDTNTANEESNNILNRIMPMKLPVKTYETDNKGNI<br>LKERPLATFYIEETETKVLKQGNFKALVKDRRLNGLFSFAETT<br>DLNLEEHPISKLSVDLELIKYQTTRISIFEMTLGLEKKLIDKY<br>STLPTDSFRNMLERWLQCKANRPELKNYVNSLIAVRNAFSHNQ<br>YPMYDATLFAEVKKFTLPSVDTKKIELNIAPQLLEIVGKAIK<br>EIEKSENKN |
| *Porphyromonas gingivalis* | 4 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFAVFFKPDD<br>FVLAKNRKEQLISVADGKECLTVSGFAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>DEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMDQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELRLLDPSSGHPFLSATMETAHRYTEGFY<br>KCYLEKKREWLAKIFYRPEQDENTKRRISVFFVPDGEARKLLP<br>LLIRRRMKEQNDLQDWIRNQAHPIDLPSHLFDSKVMELLKVK<br>DGKKKWNEAFKDWWSTKYPDGMQPFYGLRRELNIHGKSVSYIP |

TABLE 1-continued

| | | |
|---|---|---|
| | | SDGKKFADCYTHLMEKTVRDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| Bacteroides<br>pyogenes | 5 | MESIKNSQKSTGKTLQKDPPYFGLYLNMALLNVRKVENHIRKW<br>LGDVALLPEKSGFHSLLTTDNLSSAKWTRFYYKSRKFLPFLEM<br>FDSDKKSYENRRETAECLDTIDRQKISSLLKEVYGKLQDIRNA<br>FSHYHIDDQSVKHTALIISSEMHRFIENAYSFALQKTRARFTG<br>VFVETDFLQAEEKGDNKKFFAIGGNEGIKLKDNALIFLICLFL<br>DREEAFKFLSRATGFKSTKEKGFLAVRETFCALCCRQPHERLL<br>SVNPREALLMDMLNELNRCPDILFEMLDEKDQKSFLPLLGEEE<br>QAHILENSLNDELCEAIDDPFEMIASLSKRVRYKNRFPYLMLR<br>YIEEKNLLPFIRFRIDLGCLELASYPKKMGEENNYERSVTDHA<br>MAFGRLTDFHNEDAVLQQITKGITDEVRFSLYAPRYAIYNNKI<br>GFVRTSGSDKISFPTLKKKGGEGHCVAYTLQNTKSFGFISIYD<br>LRKILLLSFLDKDKAKNIVSGLLEQCEKHWKDLSENLFDAIRT<br>ELQKEFPVPLIRYTLPRSKGGKLVSSKLADKQEKYESEFERRK<br>EKLTEILSEKDFDLSQIPRRMIDEWLNVLPTSREKKLKGYVET<br>LKLDCRERLRVFEKREKGEHPLPPRIGEMATDLAKDIIRMVID<br>QGVKQRITSAYYSEIQRCLAQYAGDDNRRHLDSIIRELRLKDT<br>KNGHPFLGKVLRPGLGHTEKLYQRYFEEKKEWLEATFYPAASP<br>KRVPRFVNPPTGKQKELPLIIRNLMKERPEWRDWKQRKNSHPI<br>DLPSQLFENEICRLLKDKIGKEPSGKLKWNEMFKLYWDKEFPN<br>GMQRFYRCKRRVEVFDKVVEYEYSEEGGNYKKYYEALIDEVVR<br>QKISSSKEKSKLQVEDLTLSVRRVFKRAINEKEYQLRLLCEDD<br>RLLFMAVRDLYDWKEAQLDLDKIDNMLGEPVSVSQVIQLEGGQ<br>PDAVIKAECKLKDVSKLMRYCYDGRVKGLMPYFANHEATQEQV<br>EMELRHYEDHRRRVFNWVFALEKSVLKNEKLRRFYEESQGGCE<br>HRRCIDALRKASLVSEEEYEFLVHIRNKSAHNQFPDLEIGKLP<br>PNVTSGFCECIWSKYKAIICRIIPFIDPERRFFGKLLEQK |
| Alistipes sp.<br>ZOR0009 | 6 | MSNEIGAFREHQFAYAPGNEKQEEATFATYFNLALSNVEGMMF<br>GEVESNPDKIEKSLDTLPPAILRQIASFIWLSKEDHPDKAYST<br>EEVKVIVTDLVRRLCFYRNYFSHCFYLDTQYFYSDELVDTTAI<br>GEKLPYNFHHFITNRLFRYSLPEITLFRWNEGERKYEILRDGL<br>IFFCCLFLKRGQAERFLNELRFFKRTDEEGRIKRTIFTKYCTR<br>ESHKHIGIEEQDFLIFQDIIGDLNRVPKVCDGVVDLSKENERY<br>IKNRETSNESDENKARYRLLIREKDKFPYYLMRYIVDFGVLPC<br>ITFKQNDYSTKEGRGQFHYQDAAVAQEERCYNFVVRNGNVYYS<br>YMPQAQNVVRISELQGTISVEELRNMVYASINGKDVNKSVEQY<br>LLYHLHLLYEKITISGQTIKEGRVDVEDYRPLLDKLLLRPASN<br>GEELRRELRKLLPKRVCDLLSNRFDCSEGVSAVEKRLKAILLR<br>HEQLLLSQNPALHIDKIKSVIDYLYLFFSDDEKFRQQPTEKAH<br>RGLKDEEFQMYHYLVGDYDSHPLALWKELEASGRLKPEMRKLT<br>SATSLHGLYMLCLKGTVEWCRKQLMSIGKGTAKVEAIADRVGL<br>KLYDKLKEYTPEQLEREVKLVVMHGYAAAATPKPKAQAAIPSK<br>LTELRFYSFLGKREMSFAAFIRQDKKAQKLWLRNFYTVENIKT<br>LQKRQAAADAACKKLYNLVGEVERVHTNDKVLVLVAQRYRERL<br>LNVGSKCAVTLDNPERQQKLADVYEVQNAWLSIRFDDLDFTLT<br>HVNLSNLRKAYNLIPRKHILAFKEYLDNRVKQKLCEECRNVRR<br>KEDLCTCCSPRYSNLTSWLKENHSESSIEREAATMMLLDVERK<br>LLSFLLDERRKAIIEYGKFIPFSALVKECRLADAGLCGIRNDV<br>LHDNVISYADAIGKLSAYFPKEASEAVEYIRRTKEVREQRREE<br>LMANSSQ |
| Prevotella sp.<br>MA2016 | 7 | MSKECKKQRQEKKRRLQKANFSISLTGKHVFGAYFNMARTNFV<br>KTINYILPIAGVRGNYSENQINKMLHALFLIQAGRNEELTTEQ<br>KQWEKKLRLNPEQQTKFQKLLFKHFPVLGPMMADVADHKAYL<br>NKKKSTVQTEDETFAMLKGVSLADCLDIICLMADTLTECRNFY<br>THKDPYNKPSQLADQYLHQEMIAKKLDKVVVASRRILKDREGL<br>SVNEVEFLTGIDHLHQEVLKDEFGNAKVKDGKVMKTFVEYDD<br>FYFKISGKRLVNGYTVTTKDDKPVNVNTMLPALSDFGLLYFCV<br>LFLSKPYAKLFIDEVRLFEYSPFDDKENMIMSEMLSIYRIRTP<br>RLHKIDSHDSKATLAMDIFGELRRCPMELYNLLDKNAGQPFFH<br>DEVKHPNSHTPDVSKRLRYDDRFPTLALRYIDETELFKRIRFQ<br>LQLGSFRYKFYDKENCIDGRVRVRRIQKEINGYGRMQEVADKR<br>MDKWGDLIQKREERSVKLEHEELYINLDQFLEDTADSTPYVTD<br>ARRPYNIHANRIGLYWEDSQNPKQYKVFDENGMYIPELVVTED<br>KKAPIKMPAPRCALSVYDLPAMLFYEYLREQQDNEFPSAEQVI<br>IEYEDDYRKFFKAVAEGKLKPFKRPKEFRDFLKKEYPKLRMAD<br>IPKKLQLFLCSHGLCYNNKPETVYERLDRLTLQHLEERELHIQ<br>NRLEHYQKDRDMIGNKDNQYGKKSFSDVRHGALARYLAQSMME<br>WQPTKLKDKEKGHDKLTGLNYNVLTAYLATYGHPQVPEEGFTP<br>RTLEQVLINAHLIGGSNPHPFINKVLALGNRNIEELYLHYLEE<br>ELKHIRSRIQSLSSNPSDKALSALPFIHHDRMRYHERTSEEMM |

TABLE 1-continued

|  |  |
|---|---|
|  | ALAARYTTIQLPDGLFTPYILEILQKHYTENSDLQNALSQDVP<br>VKLNPTCNAAYLITLFYQTVLKDNAQPFYLSDKTYTRNKDGEK<br>AESFSFKRAYELFSVLNNNKKDTFPFEMIPLFLTSDEIQERLS<br>AKLLDGDGNPVPEVGEKGKPATDSQGNTIWKRRIYSEVDDYAE<br>KLTDRDMKISFKGEWEKLPRWKQDKIIKRRDETRRQMRDELLQ<br>RMPRYIRDIKDNERTLRRYKTQDMVLFLLAEKMFTNIISEQSS<br>EFNWKQMRLSKVCNEAFLRQTLTFRVPVTVGETTIYVEQENMS<br>LKNYGEFYRFLTDDRLMSLLNNIVETLKPNENGDLVIRHTDLM<br>SELAAYDQYRSTIFMLIQSIENLIITNNAVLDDPDADGFWVRE<br>DLPKRNNFASLLELINQLNNVELTDDERKLLVAIRNAFSHNSY<br>NIDFSLIKDVKHLPEVAKGILQHLQSMLGVEITK |
| Riemerella<br>anatipestifer | 8 MEKPLLPNVYTLKHKFFWGAFLNIARHNAFITICHINEQLGLK<br>TPSNDDKIVDVVCETWNNILNNDHDLLKKSQLTELILKHPPFL<br>TAMCYHPPKKEGKKKGHQKEQQKEKESEAQSQAEALNPSKLIE<br>ALEILVNQLHSLRNYYSHYKHKKPDAEKDIFKHLYKAFDASLR<br>MVKEDYKAHFTVNLTRDFAHLNRKGKNKQDNPDFNRYRFEKDG<br>FFTESGLLFFTNLFLDKRDAYWMLKKVSGFKASHKQREKMTTE<br>VFCRSRILLPKLRLESRYDHNQMLLDMLSELSRCPKLLYEKLS<br>EENKKHFQVEADGFLDEIEEEQNPFKDTLIRHQDRFPYFALRY<br>LDLNESFKSIRFQVDLGTYHYCIYDKKIGDEQEKRHLTRTLLS<br>FGRLQDFTEINRPQEWKALTKDLDYKETSNQPFISKTTPHYHI<br>TDNKIGFRLGTSKELYPSLEIKDGANRIAKYPYNSGFVAHAFI<br>SVHELLPLMFYQHLTGKSEDLLKETVRHIQRIYKDFEEERINT<br>IEDLEKANQGRLPLGAFPKQMLGLLQNKQPDLSEKAKIKIEKL<br>IAETKLLSHRLNTKLKSSPKLGKRREKLIKTGVLADWLVKDFM<br>RFQPVAYDAQNQPIKSSKANSTEFWEIRRALALYGGEKNRLEG<br>YEKQTNLIGNTNPHPELNKENWKACRNLVDEYQQYLEQREKEL<br>EAIKNQPWEPYQYCLLLKIPKENRKNLVKGWEQGGISLPRGLF<br>TEAIRETLSEDLMLSKPIRKEIKKHGRVGFISRAITLYFKEKY<br>QDKHQSFYNLSYKLEAKAPLLKREEHYEYWQQNKPQSPTESQR<br>LELHTSDRWKDYLLYKRWQHLEKKLRLYRNQDVMLWLMTLELT<br>KNHFKELNLNYHQLKLENLAVNVQEADAKLNPLNQTLPMVLPV<br>KVYPATAFGEVQYHKTPIRTVYIREEHTKALKMGNEKALVKDR<br>RLNGLESFIKEENDTQKHPISQLRLRRELEIYQSLRVDAFKET<br>LSLEEKLLNKHTSLSSLENEFRALLEEWKKEYAASSMVTDEHI<br>AFIASVRNAFCHNQYPFYKEALHAPIPLFTVAQPTTEEKDGLG<br>IAEALLKVLREYCEIVKSQI |
| Prevotella<br>aurantiaca | 9 MEDDKKTTGSISYELKDKHFWAAFLNLARHNVYITINHINKLL<br>EIREIDNDEKVLDIKTLWQKGNKDLNQKARLRELMTKHFPFLE<br>TAIYTKNKEDKKEVKQEKQAEAQSLESLKDCLFLFLDKLQEAR<br>NYYSHYKYSEFSKEPEFEEGLLEKMYNIFGNNIQLVINDYQHN<br>KDINPDEDEKHLDRKGQFKYSFADNEGNITESGLLEFVSLFLE<br>KKDAIWMQQKLNGEKDNLENKKKMTHEVECRSRILMPKLRLES<br>TQTQDWILLDMLNELIRCPKSLYERLQGDDREKEKVPFDPADE<br>DYNAEQEPEKNTLIRHQDREPYFVLRYEDYNEIEKNLREQIDL<br>GTYHFSIYKKLIGGQKEDRHLTHKLYGFERIQEFAKQNRPDEW<br>KAIVKDLDTYETSNKRYISETTPHYHLENQKIGIRERNGNKEI<br>WPSLKTNDENNEKSKYKLDKQYQAEAFLSVHELLPMMFYYLLL<br>KKEKPNNDEINASIVEGFIKREIRNIFKLYDAFANGEINNIDD<br>LEKYCADKGIPKRHLPKQMVAILYDEHKDMVKEAKRKQKEMVK<br>DTKKLLATLEKQTQKEKEDDGRNVKLLKSGEIARWLVNDMMRE<br>QPVQKDNEGKPLNNSKANSTEYQMLQRSLALYNNEEKPTRYFR<br>QVNLIESNNPHPFLKWTKWEECNNILTFYYSYLTKKIEFLNKL<br>KPEDWKKNQYFLKLKEPKTNRETLVQGWKNGENLPRGIFTEPI<br>REWFKRHQNNSKEYEKVEALDRVGLVTKVIPLEEKEEYEKDKE<br>ENEKEDTQKEINDCVQPEYNEPYNVGNIHKPKEKDELHREERI<br>ELWDKKKDKFKGYKEKIKSKKLTEKDKEEFRSYLEFQSWNKFE<br>RELRLVRNQDIVTWLLCKELIDKLKIDELNIEELKKLRLNNID<br>TDTAKKEKNNILNRVMPMELPVTVYEIDDSHKIVKDKPLHTIY<br>IKEAETKLLKQGNFKALVKDRRLNGLFSFVKTNSEAESKRNPI<br>SKLRVEYELGEYQEARIETIQDMLALEEKLINKYKDLPTNKES<br>EMLNSWLEGKDEADKARFQNDVDELIAVRNAFSHNQYPMHNKI<br>EFANIKPFSLYTANNSEEKGLGIANQLKDKTKETTDKIKKIEK<br>PIETKE |
| Prevotella<br>saccharolytica | 10 MEDKPFWAAFFNLARHNVYLTVNHINKLLDLEKLYDEGKHKEI<br>FEREDIFNISDDVMNDANSNGKKRKLDIKKIWDDLDTDLTRKY<br>QLRELILKHFPFIQPAIIGAQTKERTTIDKDKRSTSTSNDSLK<br>QTGEGDINDLLSLSNVKSMEERLLQILEQLRNYYSHVKHSKSA<br>TMPNEDEDLLNWMRYIEIDSVNKVKEDYSSNSVIDPNTSFSHL<br>IYKDEQGKIKPCRYPFTSKDGSINAFGLLEFVSLFLEKQDSIW<br>MQKKIPGFKKASENYMKMTNEVFCRNHILLPKIRLETVYDKDW<br>MLLDMLNEVVRCPLSLYKRLTPAAQNKFKVPEKSSDNANRQED<br>DNPFSRILVRHQNRFPYEVLREEDLNEVFTTLRFQINLGCYHF<br>AICKKQIGDKKEVHHLIRTLYGFSRLQNFTQNTRPEEWNTLVK<br>TTEPSSGNDGKTVQGVPLPYISYTIPHYQIENEKIGIKIFDGD<br>TAVDTDIWPSVSTEKQLNKPDKYTLTPGFKADVFLSVHELLPM<br>MFYYQLLLCEGMLKTDAGNAVEKVLIDTRNAIFNLYDAFVQEK |

TABLE 1-continued

| | | |
|---|---|---|
| | | INTITDLENYLQDKPILIGHLPKQMIDLLKGHQRDMLKAVEQK |
| | | KAMLIKDTERRLKLLDKQLKQETDVAAKNTGTLLKNGQIADWL |
| | | VNDMMRFQPVKRDKEGNPINCSKANSTEYQMLQRAFAFYATDS |
| | | CRLSRYFTQLHLIHSDNSHLFLSRFEYDKQPNLIAFYAAYLKA |
| | | KLEFLNELQPQNWASDNYFLLLRAPKNDRQKLAEGWKNGFNLP |
| | | RGLFTEKIKTWFNEHKTIVDISDCDIFKNRVGQVARLIPVFFD |
| | | KKFKDHSQPFYRYDFNVGNVSKPTEANYLSKGKREELFKSYQN |
| | | KFKNNIPAEKTKEYREYKNFSLWKKFERELRLIKNQDILIWLM |
| | | CKNLFDEKIKPKKDILEPRIAVSYIKLDSLQTNTSTAGSLNAL |
| | | AKVVPMTLAIHIDSPKPKGKAGNNEKENKEFTVYIKEEGTKLL |
| | | KWGNFKTLLADRRIKGLFSYIEHDDIDLKQHPLTKRRVDLELD |
| | | LYQTCRIDIFQQTLGLEAQLLDKYSDLNTDNFYQMLIGWRKKE |
| | | GIPRNIKEDTDFLKDVRNAFSHNQYPDSKKIAFRRIRKFNPKE |
| | | LILEEEEGLGIATQMYKEVEKVVNRIKRIELFD |
| HMPREF9712_<br>03108<br>[Myroides<br>odoratimimus<br>CCUG 10230] | 11 | MKDILTTDTTEKQNRFYSHKIADKYFFGGYFNLASNNIYEVFE<br>EVNKRNTFGKLAKRDNGNLKNYIIHVFKDELSISDFEKRVAIF<br>ASYFPILETVDKKSIKERNRTIDLTLSQRIRQFREMLISLVTA<br>VDQLRNFYTHYHHSDIVIENKVLDFLNSSFVSTALHVKDKYLK<br>TDKTKEFLKETIAAELDILIEAYKKKQIEKKNTRPFKANKREDI<br>LNAIYNEAFWSFINDKDKDKETVVAKGADAYFEKNHHKSND<br>PDFALNISEKGIVYLLSFFLTNKEMDSLKANLTGFKGKVDRES<br>GNSIKYMATQRIYSFHTYRGLKQKIRTSEEGVKETLLMQMIDE<br>LSKVPNVVYQHLSTTQQNSFIEDWNEYYKDYEDDVETDDLSRV<br>IHPVIRKRYEDRFNYFAIRFLDEFFDFPTLRFQVHLGDYVHDR<br>RTKQLGKVESDRIIKEKVTVFARLKDINSAKASYFHSLEEQDK<br>EELDNKWTLFPNPSYDFPKEHTLQHQGEQKNAGKIGIYVKLRD<br>TQYKEKAALEEARKSLNPKERSATKASKYDIITQIIEANDNVK<br>SEKPLVFTGQPIAYLSMNDIHSMLFSLLTDNAELKKTPEEVEA<br>KLIDQIGKQINEILSKDTDTKILKKYKDNDLKETDTDKITRDL<br>ARDKEEIEKLILEQKQRADDYNYTSSTKFNIDKSRKRKHLLFN<br>AEKGKIGVWLANDIKRFMFKESKSKWKGYQHTELQKLFAYFDT<br>SKSDLELILSNMVMVKDYPIELIDLVKKSRTLVDFLNKYLEAR<br>LEYIENVITRVKNSIGTPQFKTVRKECFTFLKKSNYTVVSLDK<br>QVERILSMPLFIERGFMDDKPTMLEGKSYKQHKEKFADWFVHY<br>KENSNYQNFYDTEVYEITTEDKREKAKVTKKIKQQQKNDVFTL<br>MMVNYMLEEVKLSSNDRLSLNELYQTKEERIVNKQVAKDTQE<br>RNKNYIWNKVVDLQLCDGLVHIDNVKLKDIGNFRKYENDSRVK<br>EFLTYQSDIVWSAYLSNEVDSNKLYVIERQLDNYESIRSKELL<br>KEVQEIECSVYNQVANKESLKQSGNENFKQYVLQGLLPIGMDV<br>REMLILSTDVKFKKEEIIQLGQAGEVEQDLYSLIYIRNKFAHN<br>QLPIKEFFDFCENNYRSISDNEYYAEYYMEIFRSIKEKYAN |
| Prevotella<br>intermedia | 12 | MEDDKKTTDSIRYELKDKHFWAAFLNLARHNVYITVNHINKIL<br>EEDEINRDGYENTLENSWNEIKDINKKDRLSKLIIKHFPFLEA<br>TTYRQNPTDTTKQEEKQAEAQSLESLKKSFFVFIYKLRDLRN<br>HYSHYKHSKSLERPKFEEDLQNKMYNIFDVSIQFVKEDYKHNT<br>DINPKKDFKHLDRKRKGKFHYSFADNEGNITESGLLFFVSLFL<br>EKKDAIWVQKKLEGFKCSNKSYQKMTNEVFCRSRMLLPKLRLE<br>STQTQDWILLDMLNELIRCPKSLYERLQGVNRKKFYVSFDPAD<br>EDYDAEQEPPFKNTLVRHQDRFPYFALRYFDYNEVFANLRFQID<br>LGTYHFSIYKKLIGGQKEDRHLTHKLYGFERIQEFDKQNRPDE<br>WKAIVKDSDTFKKKEEKEEEKPYISETTPHYHLENKKIGIAFK<br>NHNIWPSTQTELTNNKRKKYNLGTSIKAEAFLSVHELLPMMFY<br>YLLLKTENTKNDNKVGGKKETKKQGKHKIEAIIESKIKDIYAL<br>YDAFANGEINSEDELKEYLKGKDIKIVHLPKQMIAILKNEHKD<br>MAEKAEAKQEKMKLATENRLKTLDKQLKGKIQNGKRYNSAPKS<br>GEIASWLVNDMMRFQPVQKDENGESLNNSKANSTEYQLLQRTL<br>AFFGSEHERLAPYFKQTKLIESSNPHPFLNDTEWEKCSNILSF<br>YRSYLKARKNFLESLKPEDWEKNQYFLMLKEPKTNRETLVQGW<br>KNGFNLPRGFFTEPIRKWFMEHWKSIKVDDLKRVGLVAKVTPL<br>FFSEKYKDSVQPFYNYPFNVGDVNKPKEEDFLHREERIELWDK<br>KKDKFKGYKAKKKFKEMTDKEKEEHRSYLEFQSWNKFERELRL<br>VRNQDIVTWLLCTELIDKLKIDELNIKELKKLRLKDINTDTAK<br>KEKNNILNRVMPMELPVTVYKVNKGGYIIKNKPLHTIYIKEAE<br>TKLLKQGNFKALVKDRRLNGLFSFVKTPSEAESESNPISKLRV<br>EYELGKYQNARLDIIEDMLALEKKLIDKYNSLDTDNFHNMLTG<br>WLELKGEAKKARFQNDVKLLTAVRNAFSHNQYPMYDENLFGNI<br>ERFSLSSSNIIESKGLDIAAKLKEEVSKAAKKIQNEEDNKKEK<br>ET |
| Capnocytophaga<br>canimorsus | 13 | MKNIQRLGKGNEFSPFKKEDKFYGGFLNLANNNIEDFFKEII<br>TRFGIVITDENKKPKETFGEKILNEIFKKDISIVDYEKWVNIF<br>ADYFPPFTKYLSLYLEEMQFKNRVICFRDVMKELLKTVEALRNF<br>YTHYDHEPIKIEDRVFYFLDKVLLDVSLTVKNKYLKTDKTKEF<br>LNQHIGEELKELCQRKDYLVGKGKRIDKESEIINGIYNNAFK<br>DFICKREKQDDKENHNSVEKILCNKEPQNKKQKSSATVWELCS<br>KSSSKYTEKSFPNRENDKHCLEVPISQKGIVFLLSFFLNKGEI<br>YALTSNIKGFKAKITKEEPVTYDKNSIRYMATHRMFSFLAYKG<br>LKRKIRTSEINYNEDGQASSTYEKETLMLQMLDELNKVPDVVY |

TABLE 1-continued

```
                     QNLSEDVQKTFIEDWNEYLKENNGDVGTMEEEQVIHPVIRKRY
                     EDKFNYFAIRFLDEFAQFPTLRFQVHLGNYLCDKRTKQICDTT
                     TEREVKKKITVFGRLSELENKKAIFLNEREEIKGWEVFPNPSY
                     DFPKENISVNYKDFPIVGSILDREKQPVSNKIGIRVKIADELQ
                     KREIDKAIKEKKLRNPKNRANQDEKQKERLVNEIVSTNSNEQG
                     EPVVFIGQPTAYLSMNDIHSVLYEFLINKISGEALETKIVEKI
                     NSETQIKQIIGKDATTKILKPYTNANSINREKLLRDLEQEQQI
                     LKTLLEEQQQREKDKKDKKSKRKHELYPSEKGKVAVWLANDIK
                     RFMPKAFKEQWRGYHHSLLQKYLAYYEQSKEELKNLLPKEVFK
                     HFPFKLKGYFQQQYLNQFYTDYLKRRLSYVNELLLNIQNFKND
                     KDALKATEKECFKFFRKQNYIINPINIQIQSILVYPIFLKRGF
                     LDEKPTMIDREKFKENKDTELADWFMHYKNYKEDNYQKFYAYP
                     LEKVEEKEKFKRNKQINKQKKNDVYTLMMVEYIIQKIFGDKFV
                     EENPLVLKGIFQSKAERQQNNTHAATTQERNLNGILNQPKDIK
                     IQGKITVKGVKLKDIGNFRKYEIDQRVNTFLDYEPRKEWMAYL
                     PNDWKEKEKQGQLPPNNVIDRQISKYETVRSKILLKDVQELEK
                     IISDEIKEEHRHDLKQGKYYNFKYYILNGLLRQLKNENVENYK
                     VFKLNTNPEKVNITQLKQEATDLEQKAFVLTYIRNKFAHNQLP
                     KKEFWDYCQEKYGKIEKEKTYAEYFAEVFKREKEALIK

Porphyromonas    14  MTEQSERPYNGTYYTLEDKHFWAAFLNLARHNAYITLTHIDRQ
gulae                LAYSKADITNDQDVLSFKALWKNFDNDLERKSRLRSLILKHFS
                     FLEGAAYGKKLFESKSSGNKSSKNKELTKKEKEELQANALSLD
                     NLKSILFDFLQKLKDFRNYYSHYRHSGSSELPLFDGNMLQRLY
                     NVFDVSVQRVKIDHEHNDEVDPHYHFNHLVRKGKKDRYGHNDN
                     PSFKHHFVDGEGMVTEAGLLFFVSLFLEKRDAIWMQKKIRGFK
                     GGTETYQQMTNEVFCRSRISLPKLKLESLRMDDWMLLDMLNEL
                     VRCPKPLYDRLREDDRACFRVPVDILPDEDDTDGGGEDPFKNT
                     LVRHQDRFPYFALRYFDLKKVFTSLRFHIDLGTYHFAIYKKMI
                     GEQPEDRHLTRNLYGFGRIQDFAEEHRPEEWKRLVRDLDYFET
                     GDKPYISQTSPHYHIEKGKIGLRFMPEGQHLWPSPEVGTTRTG
                     RSKYAQDKRLTAEAFLSVHELMPMMFYYFLLREKYSEEVSAER
                     VQGRIKRVIEDVYAVYDAFARDEINTRDELDACLADKGIRRGH
                     LPRQMIAILSQEHKDMEEKIRKKLQEMMADTDHRLDMLDRQTD
                     RKIRIGRKNAGLPKSGVIADWLVRDMMRFQPVAKDASGKPLNN
                     SKANSTEYRMLQRALALFGGEKERLTPYFRQMNLTGGNNPHPF
                     LHETRWESHTNILSFYRSYLRARKAFLERIGRSDRVENRPFLL
                     LKEPKTDRQTLVAGWKGEFHLPRGIFTEAVRDCLIEMGHDEVA
                     SYKEVGFMAKAVPLYFERACEDRVQPFYDSPFNVGNSLKPKKG
                     RFLSKEERAEEWERGKERFRDLEAWSYSAARRIEDAFAGIEYA
                     SPGNKKKIEQLLRDLSLWEAFESKLKVRADRINLAKLKKEILE
                     AQEHPYHDFKSWQKFERELRLVKNQDIITWMMCRDLMEENKVE
                     GLDTGTLYLKDIRPNVQEQGSLNVLNRVKPMRLPVVVYRADSR
                     GHVHKEEAPLATVYIEERDTKLLKQGNFKSFVKDRRLNGLFSF
                     VDTGGLAMEQYPISKLRVEYELAKYQTARVCVFELTLRLEESL
                     LTRYPHLPDESFREMLESWSDPLLAKWPELHGKVRLLIAVRNA
                     FSHNQYPMYDEAVFSSIRKYDPSSPDAIEERMGLNIAHRLSEE
                     VKQAKETVERIIQA Prevotella sp.   15  MNIPALVENQKKYFGTYSVMAMLNAQTVLDHIQKVADIEGEQN
P5-125               ENNENLWFHPVMSHLYNAKNGYDKQPEKTMFIIERLQSYFPF
                     LKIMAENQREYSNGKYKQNRVEVNSNDIFEVLKRAFGVLKMY
                     RDLTNHYKTYEEKLNDGCEFLTSTEQPLSGMINNYYTVALRNM
                     NERYGYKTEDLAFIQDKRFKFVKDAYGKKKSQVNTGFFLSLQD
                     YNGDTQKKLHLSGVGIALLICLFLDKQYINIFLSRLPIFSSYN
                     AQSEERRIIIRSFGINSIKLPKDRIHSEKSNKSVAMDMLNEVK
                     RCPDELFTTLSAEKQSRFRIISDDHNEVLMKRSSDRFVPLLLQ
                     YIDYGKLFDHIRFHVNMGKLRYLLKADKTCIDGQTRVRVIEQP
                     LNGFGRLEEAETMRKQENGTFGNSGIRIRDFENMKRDDANPAN
                     YPYIVDTYTHYILENNKVEMFINDKEDSAPLLPVIEDDRYVVK
                     TIPSCRMSTLEIPAMAFHMFLFGSKKTEKLIVDVHNRYKRLFQ
                     AMQKEEVTAENIASFGIAESDLPQKILDLISGNAHGKDVDAFI
                     RLTVDDMLTDTERRIKRFKDDRKSIRSADNKMGKRGFKQISTG
                     KLADFLAKDIVLFQPSVNDGENKITGLNYRIMQSAIAVYDSGD
                     DYEAKQQFKLMFEKARLIGKGTTEPHPFLYKVFARSIPANAVE
                     FYERYLIERKFYLTGLSNEIKKGNRVDVPFIRRDQNKWKTPAM
                     KTLGRIYSEDLPVELPRQMFDNEIKSHLKSLPQMEGIDFNNAN
                     VTYLIAEYMKRVLDDDFQTFYQWNRNYRYMDMLKGEYDRKGSL
                     QHCFTSVEEREGLWKERASRTERYRKQASNKIRSNRQMRNASS
                     EEIETILDKRLSNSRNEYQKSEKVIRRYRVQDALLFLLAKKTL
                     TELADFPDGERFKLKEIMPDAEKGILSEIMPMSFTFEKGGKKYT
                     ITSEGMKLKNYGDFFVLASDKRIGNLLELVGSDIVSKEDIMEE
                     FNKYDQCRPEISSIVFNLEKWAFDTYPELSARVDREEKVDFKS
                     ILKILLNNKNINKEQSDILRKIRNAFDHNNYPDKGVVEIKALP
                     EIAMSIKKAFGEYAIMK Flavobacterium   16  MENLNKILDKENEICISKIFNTKGIAAPITEKALDNIKSKQKN
branchiophilum       DLNKEARLHYFSIGHSFKQIDTKKVFDYVLIEELKDEKPLKFI
                     TLQKDFFTKEFSIKLQKLINSIRNINNHYVHNFNDINLNKIDS
                     NVFHFLKESFELAIIEKYYKVNKKYPLDNEIVLFLKELFIKDE
```

TABLE 1-continued

|  |  |
|---|---|
| | NTALLNYFTNLSKDEAIEYILTFTITENKIWNINNEHNILNIE<br>KGKYLTFEAMLFLITIFLYKNEANHLLPKLYDFKNNKSKQELF<br>TFFSKKFTSQDIDAEEGHLIKFRDMIQYLNHYPTAWNNDLKLE<br>SENKNKIMTTKLIDSIIEFELNSNYPSFATDIQFKKEAKAFLF<br>ASNKKRNQTSFSNKSYNEEIRHNPHIKQYRDEIASALTPISFN<br>VKEDKFKIFVKKHVLEEYFPNSIGYEKFLEYNDFTEKEKEDFG<br>LKLYSNPKTNKLIERIDNHKLVKSHGRNQDRFMDFSMRFLAEN<br>NYFGKDAFFKCYKFYDTQEQDEFLQSNENNDDVKFHKGKVTTY<br>IKYEEHLKNYSYWDCPFVEENNSMSVKISIGSEEKILKIQRNL<br>MIYFLENALYNENVENQGYKLVNNYYRELKKDVEESIASLDLI<br>KSNPDFKSKYKKILPKRLLHNYAPAKQDKAPENAFETLLKKAD<br>FREEQYKKLLKKAEHEKNKEDFVKRNKGKQFKLHFIRKACQMM<br>YFKEKYNTLKEGNAAFEKKDPVIEKRKNKEHEFGHHKNLNITR<br>EEFNDYCKWMFAFNGNDSYKKYLRDLFSEKHFFDNQEYKNLFE<br>SSVNLEAFYAKTKELFKKWIETNKPTNNENRYTLENYKNLILQ<br>KQVFINVYHFSKYLIDKNLLNSENNVIQYKSLENVEYLISDFY<br>FQSKLSIDQYKTCGKLFNKLKSNKLEDCLLYEIAYNYIDKKNV<br>HKIDIQKILTSKIILTINDANTPYKISVPFNKLERYTEMIAIK<br>NQNNLKARFLIDLPLYLSKNKIKKGKDSAGYEIIIKNDLEIED<br>INTINNKIINDSVKFTEVLMELEKYFILKDKCILSKNYIDNSE<br>IPSLKQFSKVWIKENENEIINYRNIACHFHLPLLETFDNLLLN<br>VEQKFIKEELQNVSTINDLSKPQEYLILLFIKFKHNNFYLNLF<br>NKNESKTIKNDKEVKKNRVLQKFINQVILKKK |
| *Myroides<br>odoratimimus* | 17 MKDILTTDTTEKQNRFYSHKIADKYFFGGYFNLASNNIYEVFE<br>EVNKRNTFGKLAKRDNGNLKNYIIHVFKDELSISDFEKRVAIF<br>ASYFPILETVDKKSIKERNRTIDLTLSQRIRQFREMLISLVTA<br>VDQLRNFYTHYHHSDIVIENKVLDFLNSSFVSTALHVKDKYLK<br>TDKTKEFLKETIAAELDILIEAYKKKQIEKKNTRFKANKREDI<br>LNAIYNEAFWSFINDKDKDKETVVAKGADAYFEKNHHKSND<br>PDFALNISEKGIVYLLSFFLTNKEMDSLKANLTGFKGKVDRES<br>GNSIKYMATQRIYSFHTYRGLKQKIRTSEEGVKETLLMQMIDE<br>LSKVPNVVYQHLSTTQQNSFIEDWNEYYKDYEDDVETDDLSRV<br>THPVIRKRYEDRFNYFAIRFLDEFFDFPTLRFQVHLGDYVHDR<br>RTKQLGKVESDRIIKEKVTVFARLKDINSAKASYFHSLEEQDK<br>EELDNKWTLFPNPSYDFPKEHTLQHQGEQKNAGKIGIYVKLRD<br>TQYKEKAALEEARKSLNPKERSATKASKYDIITQIIEANDNVK<br>SEKPLVFTGQPIAYLSMNDIHSMLFSLLTDNAELKKTPEEVEA<br>KLIDQIGKQINEILSKDTDTKILKKYKDNDLKETDTDKITRDL<br>ARDKEEIEKLILEQKQRADDYNYTSSTKFNIDKSRKRKHLLFN<br>AEKGKIGVWLANDIKRFMFKESKSKWKGYQHIELQKLFAYFDT<br>SKSDLELILSNMVMVKDYPIELIDLVKKSRTLVDFLNKYLEAR<br>LEYIENVITRVKNSIGTPQFKTVRKECFTFLKKSNYTVVSLDK<br>QVERILSMPLFIERGFMDDKPTMLEGKSYKQHKEKFADWFVHY<br>KENSNYQNFYDTEVYEITTEDKREKAKVTKKIKQQQKNDVFTL<br>MMVNYMLEEVLKLSSNDRLSLNELYQTKEERIVNKQVAKDTQE<br>RNKNYIWNKVVDLQLCDGLVHIDNVKLKDIGNFRKYENDSRVK<br>EFLTYQSDIVWSAYLSNEVDSNKLYVIERQLDNYESIRSKELL<br>KEVQBEIECSVYNQVANKESLKQSGNENFKQYVLQGLLPIGMDV<br>REMLILSTDVKFKKEEIIQLGQAGEVEQDLYSLIYIRNKFAHN<br>QLPIKEFFDFCENNYRSISDNEYYAEYYMEIFRSIKEKYAN |
| *Flavobacterium<br>columnare* | 18 MSSKNESYNKQKTFNHYKQEDKYFFGGFLNNADDNLRQVGKEF<br>KTRINFNHINNNELASVFKDYFNKEKSVAKREHALNLLSNYFP<br>VLERIQKHTNHNFEQTREIFELLLDTIKKLRDYYTHHYHKPIT<br>INPKIYDFLDDTLLDVLITIKKKKVKNDTSRELLKEKLRPELT<br>QLKNQKREELIKKGKKLLEENLENAVFNHCLIPFLEENKTDDK<br>QNKTVSLRKYRKSKPNEETSITLTQSGLVFLMSFFLHRKEFQV<br>FTSGLERFKAKVNTIKEEEISLNKNNIVYMITHWSYSYYNFKG<br>LKHRIKTDQGVSTLEQNNTTHSLTNTNTKEALLTQIVDYLSKV<br>PNEIYETLSEKQQKEFEEDINEYMRENPENEDSTFSSIVSHKV<br>IRRKRYENKFNYFAMRFLDEYAELPTLRFMVNFGDYIKDRQKKI<br>LESIQFDSERIIKKEIHLFEKLSLVTEYKKNVYLKETSNIDLS<br>RFPLFPNPSYVMANNNIPFYIDSRSNNLDEYLNQKKKAQSQNK<br>KRNLTFEKYNKEQSKDAIIAMLQKEIGVKDLQQRSTIGLLSCN<br>ELPSMLYEVIVKDIKGAELENKIAQKIREQYQSIRDFTLDSPQ<br>KDNIPTTLIKTINTDSSVTFENQPIDIPRLKNALQKELTLTQE<br>KLLNVKEHEIEVDNYNRNKNTYKFKNQPKNKVDDKKLQRKYVF<br>YRNEIRQEANWLASDLIHFMKNKSLWKGYMHNELQSFLAFFED<br>KKNDCIALLETVFNLKEDCILTKGLKNLFLKHGNFIDFYKEYL<br>KLKEDFLSTESTFLENGFIGLPPKILKKELSKRLKYIFIVFQK<br>RQFIIKELEEKKNNLYADAINLSRGIFDEKPTMIPFKKPNPDE<br>FASWFVASYQYNNYQSFYELTPDIVERDKKKKYKNLRAINKVK<br>IQDYYLKLMVDTLYQDLFNQPLDKSLSDFYVSKAEREKIKADA<br>KAYQKLNDSSLWNKVIHLSLQNNRITANPKLKDIGKYKRALQD<br>EEKIATLLTYDARTWTYALQKPEKNENDYKELHYTALNMELQE |

TABLE 1-continued

|  |  |
|---|---|
|  | FYEKVRSKELLKQVQELEKKILDKYDFSNNASHPEDLEIEDKK<br>GKRHPNFKLYITKALLKNESEIINLENIDIEILLKYYDYNTEE<br>LKEKIKNMDEDEKAKIINTKENYNKITNVLIKKALVLIIIRNK<br>MAHNQYPPKFIYDLANRFVPKKEEEYFATYFNRVFETITKELW<br>ENKEKKDKTQV |
| Porphyromonas gingivalis | 19 MTEQNEKPYNGTYYTLEDKHFWAAFLNLARHNAYITLAHIDRQ<br>LAYSKADITNDEDILFFKGQWKNLDNDLERKARLRSLILKHFS<br>FLEGAAYGKKLFESQSSGNKSSKKKELSKKEKEELQANALSLD<br>NLKSILFDFLQKLKDFRNYYSHYRHPESSELPLFDGNMLQRLY<br>NVFDVSVQRVKRDHEHNDKVDPHRHFNHLVRKGKKDKYGNNDN<br>PFFKHHFVDREGTVTEAGLLFFVSLFLEKRDAIWMQKKIRGFK<br>GGTEAYQQMTNEVFCRSRISLPKLKLESLRTDDWMLLDMLNEL<br>VRCPKSLYDRLREEDRARFRVPVDILSDEDDTDGTEEDPFKNT<br>LVRHQDRFPYFALRYFDLKKVFTSLRFHIDLGTYHFAIYKKNI<br>GEQPEDRHLTRNLYGFGRIQDFAEEHRPEEWKRLVRDLDYFET<br>GDKPYITQTTPHYHIEKGKIGLRFVPEGQHLWPSPEVGATRTG<br>RSKYAQDKRLTAEAFLSVHELMPMNIFYYFLLREKYSEEVSAE<br>KVQGRIKRVIEDVYAVYDAFARDEINTRDELDACLADKGIRRG<br>HLPRQMIAILSQEHKDMEEKVRKKLQEMIADTDHRLDMLDRQT<br>DRKIRIGRKNAGLPKSGVVADWLVRDMMRFQPVAKDTSGKPLN<br>NSKANSTEYRMLQRALALFGGEKERLTPYFRQMNLTGGNNPHP<br>FLHETRWESHTNILSFYRSYLEARKAFLQSIGRSDRVENHRFL<br>LLKEPKTDRQTLVAGWKGEFHLPRGIFTEAVRDCLIEMGYDEV<br>GSYKEVGFMAKAVPLYFERASKDRVQPFYDYPFNVGNSLKPKK<br>GRFLSKEKRAEEWESGKERFRLAKLKKEILEAKEHPYHDFKSW<br>QKFERELRLVKNQDIITWMMCRDLMEENKVEGLDTGTLYLKDI<br>RTDVQEQGSLNVLNRVKPMRLPVVVYRADSRGHVHKEQAPLAT<br>VYIEERDTKLLKQGNFKSFVKDRRLNGLFSFVDTGALAMEQYP<br>ISKLRVEYELAKYQTARVCAFEQTLELEESLLTRYPHLPDKNF<br>RKMLESWSDPLLDKWPDLHGNVRLLIAVRNAFSHNQYPMYDET<br>LFSSIRKYDPSSPDAIEERMGLNIAHRLSEEVKQAKEMVERII<br>QA |
| Porphyromonas sp. COT-052 OH4946 | 20 MTEQSERPYNGTYYTLEDKHFWAAFLNLARHNAYITLTHIDRQ<br>LAYSKADITNDQDVLSFKALWKNFDNDLERKSRLRSLILKHFS<br>FLEGAAYGKKLFESKSSGNKSSKNKELTKKEKEELQANALSLD<br>NLKSILFDFLQKLKDFRNYYSHYRHSESSELPLFDGNMLQRLY<br>NVFDVSVQRVKRDHEHNDKVDPHRHFNHLVRKGKKDRYGHNDN<br>PSFKHHFVDSEGMVTEAGLLFFVSLFLEKRDAIWMQKKIRGFK<br>GGTETYQQMTNEVFCRSRISLPKLKLESLRTDDWMLLDMLNEL<br>VRCPKPLYDRLREDDRACFRVPVDILPDEDDTDGGGEDPFKNT<br>LVRHQDRFPYFALRYFDLKKVFTSLRFHIDLGTYHFAIYKKMI<br>GEQPEDRHLTRNLYGFGRIQDFAEEHRPEEWKRLVRDLDYFET<br>GDKPYISQTTPHYHIEKGKIGLRFVPEGQHLWPSPEVGTTRTG<br>RSKYAQDKRLTAEAFLSVHELMPMMFYYFLLREKYSEEVSAEK<br>VQGRIKRVIEDVYAIYDAFARDEINTLKELDACLADKGIRRGH<br>LPKQMIGILSQERKDMEEKVRKKLQEMIADTDHRLDMLDRQTD<br>RKIRIGRKNAGLPKSGVIADWLVRDMMRFQPVAKDTSGKPLNN<br>SKANSTEYRMLQRALALFGGEKERLTPYFRQMNLTGGNNPHPF<br>LHETRWESHTNILSFYRSYLRARKAFLERIGRSDRVENCPFLL<br>LKEPKTDRQTLVAGWKGEFHLPRGIFTEAVRDCLIEMGYDEVG<br>SYREVGFMAKAVPLYFERACEDRVQPFYDSPFNVGNSLKPKKG<br>RFLSKEDRAEEWERGKERFRDLEAWSHSAARRIKDAFAGIEYA<br>SPGNKKKIEQLLRDLSLWEAFESKLKVRADKINLAKLKKEILE<br>AQEHPYHDFKSWQKFERELRLVKNQDIITWMMCRDLMEENKVE<br>GLDTGTLYLKDIRPNVQEQGSLNVLNRVKPMRLPVVVYRADSR<br>GHVHKEEAPLATVYIEERDTKLLKQGNFKSFVKDRRLNGLFSF<br>VDTGGLAMEQYPISKLRVEYELAKYQTARVCVFELTLRLEESL<br>LSRYPHLPDESFREMLESWSDPLLAKWPELHGKVRLLIAVRNA<br>FSHNQYPMYDEAVFSSIRKYDPSSPDAIEERMGLNIAHRLSEE<br>VKQAKETVERIIQA |
| Prevotella intermedia | 21 MEDDKKTKESTNMLDNKHFWAAFLNLARHNVYITVNHINKVLE<br>LKNKKDQDIIIDNDQDILAIKTHWEKVNGDLNKTERLRELMTK<br>HFPPFLETAIYTKNKEDKEEVKQEKQAKAQSFDSLKHCLFLFLE<br>KLQEARNYYSHYKYSESTKEPMLEKELLKKMYNIFDDNIQLVI<br>KDYQHNKDINPDEDFKHLDRTEEEFNYYFTTNKKGNITASGLL<br>FFVSLFLEKKDAIWMQQKLRGFKDNRESKKKMTHEVFCRSRML<br>LPKLRLESTQTQDWILLDMLNELIRCPKSLYERLQGEYRKKFN<br>VPFDSADEDYDAEQEPFKNTLVRHQDRFPYFALRYFDYNEIFT<br>NLRFQIDLGTYHFSIYKKLIGGQKEDRHLTHKLYGFERIQEFA<br>KQNRTDEWKAIVKDFDTYETSEEPYISETAPHYHLENQKIGIR<br>FRNDNDEIWPSLKTNGENNEKRKYKLDKQYAEAFLSVHELLP<br>MMFYYLLLKKEEPNNDKKNASIVEGFIKREIRDIYKLYDAFAN<br>GEINNIDDLEKYCEDKGIPKRHLPKQMVAILYDEHKDMAEEEAK<br>RKQKEMVKDTKKLLATLEKQTQGEIEDGGRNIRLLKSGEIARW<br>LVNDMMRFQPVQKDNEGNPLNNSKANSTEYQMLQRSLALYNKE<br>EKPTRYFRQVNLINSSNPHPFLKWTKWEECNNILSFYRSYLTK<br>KIEFLNKLKPEDWEKNQYFLKLKEPKTNRETLVQGWKNGFNLP |

TABLE 1-continued

```
RGIFTEPIREWFKRHQNDSEEYEKVETLDRVGLVTKVIPLFFK
KEDSKDKEEYLKKDAQKEINNCVQPFYGFPYNVGNIHKPDEKD
FLPSEERKKLWGDKKYKFKGYKAKVKSKKLTDKEKEEYRSYLE
FQSWNKFERELRLVRNQDIVTWLLCTELIDKLKVEGLNVEELK
KLRLKDIDTDTAKQEKNNILNRVMPMQLPVTVYEIDDSHNIVK
DRPLHTVYIEETKTKLLKQGNFKALVKDRRLNGLFSFVDTSSE
TELKSNPISKSLVEYELGEYQNARIETIKDMLLLEETLIEKYK
TLPTDNFSDMLNGWLEGKDEADKARFQNDVKLLVAVRNAFSHN
QYPMRNRIAFANINPFSLSSADTSEEKKLDIANQLKDKTHKII
KRIIEIEKPIETKE
```

TABLE 2

| Ortholog | No. | Accessory protein | 5'PFS | 3'PFS |
|---|---|---|---|---|
| Bergeyella zoohelcum | 1 | | A | NGA |
| Bergeyella zoohelcum | 1 | csx27 | A | NGA |
| Prevotella intermedia | 2 | | A | NGA |
| Prevotella intermedia | 2 | csx28 | A | NGA |
| Prevotella buccae | 3 | | A | NGA |
| Prevotella buccae | 3 | csx28 | A | NGA |
| Bacteroides pyogenes | 5 | | A | NGA |
| Alistipes sp. ZOR0009 | 6 | | TG | NA(G) |
| Prevotella sp. MA2016 | 7 | | AT | |
| Riemerella anatipestifer | 8 | | A | NGA |
| Riemerella anatipestifer | 8 | csx28 | A | NGA |
| Prevotella aurantiaca | 9 | | G | NAA |
| Prevotella aurantiaca | 9 | csx28 | | |
| Prevotella saccharolytica | 10 | | AG | |
| Prevotella intermedia | 12 | | AG | |
| Capnocytophaga canimorsus | 13 | | A | NAA |
| Capnocytophaga canimorsus | 13 | csx27 | A | NAA |
| Porphyromonas gulae | 14 | | A | NAA |
| Porphyromonas gulae | 14 | csx28 | A | NGA |
| Prevotella sp. P5-125 | 15 | | AT | |
| Flavobacterium branchiophilum | 16 | | TG | |
| Flavobacterium branchiophilum | 16 | csx27 | TA | |
| Myroides odoratimimus | 17 | | T | NAA |
| Porphyromonas gingivalis | 19 | | A | NAA |
| Porphyromonas gingivalis | 19 | csx28 | A | |
| Prevotella intermedia | 21 | | A | NGA |
| Prevotella intermedia | 21 | csx28 | A | NGA |

Example 2g Activity of Cas3b in Mammalian Cells

BTEK293T cells were transfected using the standard lipofectamine 2000 protocol with the following plasmids:

(a) Cas3b (or control C2c2) mammalian expression plasmid, with a X Nuclear Export Sequence tag on the C-term of the gene.

(b) crRNA expression plasmid, each expressing either a targeting crRNA against *Gaussia* Luciferase or a non-targeting crRNA.

(c) Luciferase reporter plasmid, expressing *Gaussia* and *Cypridina* luciferase from two separate promoters.

*Gaussia* luciferase was targeted for knockdown, and the level of cypridinia luciferase was used to control for transfection efficiency. *Leptotrichia wadeii* C2c2 was used for comparison with C2c2 orthologs.

The following spacer sequences were used in the respective guides:

TABLE 3

| | |
|---|---|
| Cas13b-guide 2 | GGGCATTGGCTTCCATCTCTTTGAGCACCT (SEQ ID NO: 167) |
| Cas13b-guide NT | GCAGGGTTTTCCCAGTCACGACGTTGTAAA (SEQ ID NO: 168) |
| Experiment #2 (14 vs. 15 vs. C2c2) | |
| Cas13b-guide0 | GAAGTCTTCGTTGTTCTCGGTGGGCTTGGC (SEQ ID NO: 169) |
| Cas13b-guide1 | GGGCATTGGCTTCCATCTCTTTGAGCACCT (SEQ ID NO: 170) |
| Cas13b-guide2 | GACAGGCAGATCAGACAGCCCCTGGTGCAG (SEQ ID NO: 171) |
| Cas13b-guide3 | GTAGGTGTGGCAGCGTCCTGGGATGAACTT (SEQ ID NO: 172) |
| Cas13b-guide4 | GGAATGTCGACGATCGCCTCGCCTATGCCG (SEQ ID NO: 173) |
| C2c2-guide0 | AGTCTTCGTTGTTCTCGGTGGGCTTGGC (SEQ ID NO: 174) |
| C2c2-guide1 | GCATTGGCTTCCATCTCTTTGAGCACCT (SEQ ID NO: 175) |
| C2c2-guide2 | CAGGCAGATCAGACAGCCCCTGGTGCAG (SEQ ID NO: 176) |
| C2c2-guide3 | AGGTGTGGCAGCGTCCTGGGATGAACTT (SEQ ID NO: 177) |

TABLE 3-continued

| | |
|---|---|
| C2c2-guide4 | AATGTCGACGATCGCCTCGCCTATGCCG (SEQ ID NO: 178) |
| Cas13b-guide NT | GCAGGGTTTTCCCAGTCACGACGTTGTAAA (SEQ ID NO: 179) |
| C2c2-guide NT | AGGGTTTTCCCAGTCACGACGTTGTAAA (SEQ ID NO: 180) |

The results for the different Cas13b orthologs are provided in FIG. 2. The orthologs are classified as Low/No activity, Medium, High, or Gold. "Gold" orthologs provided >80% knockdown of luciferase activity with the majority of guides tested. "High" orthologs provided >50% knockdown of luciferase activity with the majority of guides tested. "Medium" orthologs provided ~50% knockdown of luciferase activity with the majority of guides tested. "Low/No" orthologs provided <80% knockdown of luciferase activity with all of guides tested.

FIG. 3 shows normalised comparison data for the activity of several of the orthologs tested, using Guide 2 (GGGCATTGGCTTCCATCTCTTTGAGCACCT) (SEQ ID NO: 181) and a non-targeting guide as control (GCAGGGTTTTCCCAGTCACGACGTTGTAAA) (SEQ ID NO: 182). It can be seen that the Cas13b orthologs nos. 14, 15, 19, and 20 (from *Porphyromonas gulae*, *Prevotella* sp. P5-125, *Porphyromonas gingivalis*, and *Porphyromonas* sp. COT-052OH4946) are particularly active in mammalian cells.

Figure 4:
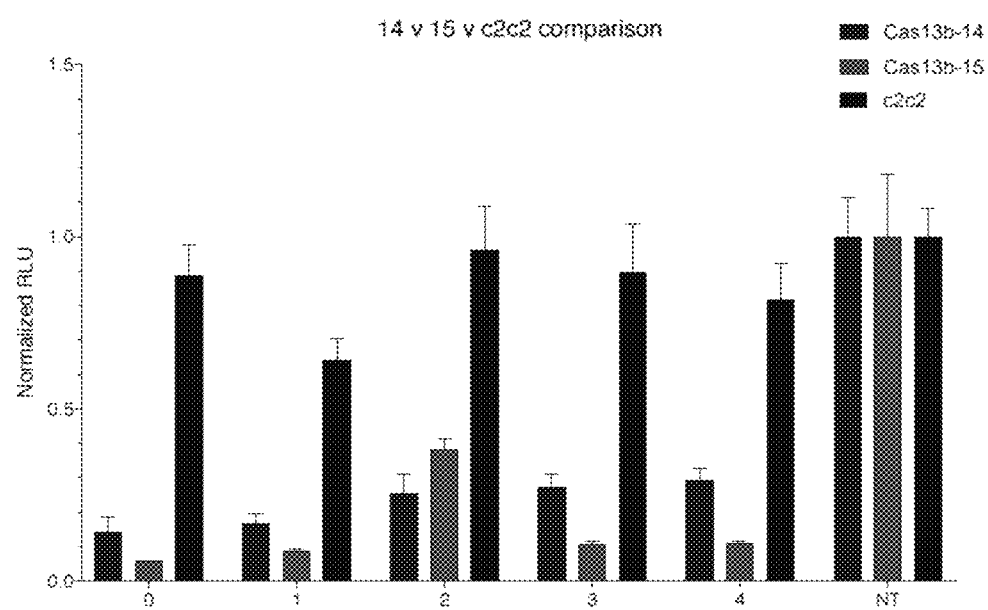
FIG. 4 compares activity of two of the Cas13b orthologs—*Porphyromonas gulae* WP_039434803 and *Prevotella* sp. P5-125 WP_044065294—with activity of C2c2/Cas13a across various guide sequences.

FIG. 4 shows normalised data comparing the two most effective orthologs, 14 and 15, with C2c2/Cas13a, using several luciferase-targeting guides and a non-targeting control guide. It can be seen that the Cas13b orthologs nos. 14 and 15 (from *Porphyromonas gulae* and *Prevotella* sp. P5-125) are consistently more active than *Leptotrichia wadeii* C2c2 in mammalian cells.

Example 3

Efficient and precise nucleic acid editing holds great promise for treating genetic disease, particularly at the level of RNA, where disease-relevant transcripts can be rescued to yield functional protein products. Type VI CRISPR-Cas systems contain the programmable single-effector RNA-guided RNases Cas13. Here, we profile the diversity of Type VI systems to engineer a Cas13 ortholog capable of robust knockdown and demonstrate RNA editing by using catalytically-inactive Cas13 (dCas13) to direct adenosine deaminase activity to transcripts in mammalian cells. By fusing the ADAR2 deaminase domain to dCas13 and engineering guide RNAs to create an optimal RNA duplex substrate, we achieve targeted editing of specific single adenosines to inosines (which is read out as guanosine during translation) with efficiencies routinely ranging from 20-40% and up to 89%. This system, referred to as RNA Editing for Programmable A to I Replacement (REPAIR), can be further engineered to achieve high specificity. An engineered variant, REPAIRv2, displays greater than 170-fold increase in specificity while maintaining robust on-target A to I editing. We use REPAIRv2 to edit full-length transcripts containing known pathogenic mutations and create functional truncated versions suitable for packaging in adeno-associated viral (AAV) vectors. REPAIR presents a promising RNA editing platform with broad applicability for research, therapeutics, and biotechnology. Precise nucleic acid editing technologies are valuable for studying cellular function and as novel therapeutics. Although current editing tools, such as the Cas9 nuclease, can achieve programmable modification of genomic loci, edits are often heterogenous due to insertions or deletions or require a donor template for precise editing. Base editors, such as dCas9-APOBEC fusions, allow for editing without generating a double stranded break, but may lack precision due to the nature of cytidine deaminase activity, which edits any cytidine in a target window. Furthermore, the requirement for a protospacer adjacent motif (PAM) limits the number of possible editing sites. Here, we describe the development of a precise and flexible RNA base editing tool using the RNA-guided RNA targeting Cas13 enzyme from type VI prokaryotic clustered regularly interspaced short palindromic repeats (CRISPR) adaptive immune system.

Precise nucleic acid editing technologies are valuable for studying cellular function and as novel therapeutics. Current editing tools, based on programmable nucleases such as the prokaryotic clustered regularly interspaced short palindromic repeats (CRISPR)-associated nucleases Cas9 (1-4) or Cpf1(5), have been widely adopted for mediating targeted DNA cleavage which in turn drives targeted gene disruption through non-homologous end joining (NHEJ) or precise gene editing through template-dependent homology-directed repair (HDR)(6). NHEJ utilizes host machineries that are active in both dividing and post-mitotic cells and provides efficient gene disruption by generating a mixture of insertion or deletion (indel) mutations that can lead to frame shifts in protein coding genes. HDR, in contrast, is mediated by host machineries whose expression is largely limited to replicating cells. As such, the development of gene-editing capabilities in post-mitotic cells remains a major challenge. Recently, DNA base editors, such as the use of catalytically inactive Cas9 (dCas9) to target cytidine deaminase activity to specific genome targets to effect cytosine to thymine conversions within a target window, allow for editing without generating a DNA double strand break and significantly reduces the formation of indels(7, 8). However the targeting range of DNA base editors is limited due to the requirement of Cas9 for a protospacer adjacent motif (PAM) at the editing site(9). Here, we describe the development of a precise and flexible RNA base editing technology using the type VI CRISPR-associated RNA-guided RNase Cas13(10-13).

Cas13 enzymes have two Higher Eukaryotes and Prokaryotes Nucleotide-binding (HEPN) endoRNase domains that mediate precise RNA cleavage(10, 11). Three Cas13 protein families have been identified to date: Cas13a (previously known as C2c2), Cas13b, and Cas13c(12, 13). We recently reported Cas13a enzymes can be adapted as tools for nucleic acid detection(14) as well as mammalian and plant cell RNA knockdown and transcript tracking(15). The RNA-guided nature of Cas13 enzymes makes them attractive tool for RNA binding and perturbation applications.

The adenosine deaminase acting on RNA (ADAR) family of enzymes mediates endogenous editing of transcripts via hydrolytic deamination of adenosine to inosine, a nucleobase that is functionally equivalent to guanosine in translation and splicing(16). There are two functional human ADAR orthologs, ADAR1 and ADAR2, which consist of N-terminal double stranded RNA-binding domains and a C-terminal catalytic deamination domain. Endogenous target sites of ADAR1 and ADAR2 contain substantial double stranded identity, and the catalytic domains require duplexed regions for efficient editing in vitro and in vivo(17, 18). Although ADAR proteins have preferred motifs for editing that could restrict the potential flexibility of targeting, hyperactive mutants, such as ADAR(E488Q)(19), relax sequence constraints and improve adenosine to inosine editing rates. ADARs preferentially deaminate adenosines opposite cytidine bases in RNA duplexes(20), providing a promising opportunity for precise base editing. Although previous approaches have engineered targeted ADAR fusions via RNA guides (21-24), the specificity of these approaches has not been reported and their respective targeting mechanisms rely on RNA-RNA hybridization without the assistance of protein partners that may enhance target recognition and stringency.

Here, we assay the entire family of Cas13 enzymes for RNA knockdown activity in mammalian cells and identify the Cas13b ortholog from *Prevotella* sp. P5-125 (PspCas13b) as the most efficient and specific for mammalian cell applications. We then fuse the ADAR2 deaminase domain (ADARDD) to catalytically inactive PspCas13b and demonstrate RNA editing for programmable A to I (G) replacement (REPAIR) of reporter and endogenous transcripts as well as disease-relevant mutations. Lastly, we employ a rational mutagenesis scheme to improve the specificity of dCas13b-ADAR2DD fusions to generate REPAIRv2 with more than 170 fold increase in specificity.

Design and Cloning of Bacterial Constructs

Mammalian codon optimized Cas13b constructs were cloned into the chloramphenicol resistant pACYC184 vector under control of the Lac promoter. Two corresponding direct-repeat (DR) sequences separated by BsaI restriction sites were then inserted downstream of Cas13b, under control of the pJ23119 promoter. Last, oligos for targeting spacers were phosphorylated using T4 PNK (New England Biolabs), annealed and ligated into BsaI digested vectors using T7 ligase (Enzymatics) to generate targeting Cas13b vectors.

Bacterial PFS Screens

Ampicillin resistance plasmids for PFS screens were cloned by inserting PCR products containing Cas13b targets with 2 5' randomized nucleotides and 4 3' randomized nucleotides separated by a target site immediately downstream of the start codon of the ampicillin resistance gene bla using NEB Gibson Assembly (New England Biolabs). 100 ng of ampicillin-resistant target plasmids were then electroporated with 65-100 ng chloramphenicol-resistant Cas13b bacterial targeting plasmids into Endura Electrocompetent Cells. Plasmids were added to cells, incubated 15 minutes on ice, electroporated using the manufacturer's protocol, and then 950 uL of recovery media was added to cells before a one hour outgrowth at 37 C. The outgrowth was plated onto chloramphenicol and ampicillin double selection plates. Serial dilutions of the outgrowth were used to estimate the cfu/ng DNA. 16 hours post plating, cells were scraped off plates and surviving plasmid DNA harvested using the Qiagen Plasmid Plus Maxi Kit (Qiagen). Surviving Cas13b target sequences and their flanking regions were amplified by PCR and sequenced using an Illumina NextSeq. To assess PFS preferences, the positions containing randomized nucleotides in the original library were extracted, and sequences depleted relative to the vector only condition that were present in both bioreplicates were extracted using custom python scripts. The $-\log 2$ of the ratio of PFS abundance in the Cas13b condition compared to the vector only control was then used to calculate preferred motifs. Specifically, all sequences having $-\log 2$(sample/vector) depletion ratios above a specific threshold were used to generate weblogos of sequence motifs (weblogo.berkeley.edu). The specific depletion ratio values used to generate weblogos for each Cas13b ortholog are listed in Table 7.

Design and Cloning of Mammalian Constructs for RNA Interference

To generate vectors for testing Cas13 orthologs in mammalian cells, mammalian codon optimized Cas13a, Cas13b, and Cas13c genes were PCR amplified and golden-gate cloned into a mammalian expression vector containing dual NLS sequences and a C-terminal msfGFP, under control of the EF1alpha promoter. For further optimization Cas13 orthologs were golden gate cloned into destination vectors containing different C-terminal localization tags under control of the EF1alpha promoter.

The dual luciferase reporter was cloned by PCR amplifying *Gaussia* and *Cypridina* luciferase coding DNA, the EF1alpha and CMV promoters and assembly using the NEB Gibson Assembly (New England Biolabs).

For expression of mammalian guide RNA for Cas13a, Cas13b, or Cas13c orthologs, the corresponding direct repeat sequences were synthesized with golden-gate acceptor sites and cloned under U6 expression via restriction digest cloning. Individual guides were then cloned into the corresponding expression backbones for each ortholog by golden gate cloning.

Cloning of Pooled Mismatch Libraries for Cas13 Interference Specificity

Pooled mismatch library target sites were created by PCR. Oligos containing semi-degenerate target sequences in G-luciferase containing a mixture of 94% of the correct base and 2% of each incorrect base at each position within the target were used as one primer, and an oligo corresponding to a non-targeted region of G-luciferase was used as the second primer in the PCR reaction. The mismatch library target was then cloned into the dual luciferase reporter in place of the wildtype G-luciferase using NEB Gibson assembly (New England Biolabs).

Design and Cloning of Mammalian Constructs for RNA Editing

PspCas13b was made catalytically inactive (dPspCas13b) via two histidine to alanine mutations (H133A/H1058A) at the catalytic site of the HEPN domains. The deaminase domains of human ADAR1 and ADAR2 were synthesized and PCR amplified for gibson cloning into pcDNA-CMV vector backbones and were fused to dPspCas13b at the C-terminus via GS or GSGGGGS (SEQ ID NO: 183) linkers. For the experiment in which we tested different linkers we cloned the following additional linkers between dPspCas13b and ADAR2dd: GGGGSGGGGSGGGGS (SEQ ID NO: 184), EAAAK (SEQ ID NO: 185), GGSGGSGGSGGSGGSGGS (SEQ ID NO: 186), and SGSETPGTSESATPES (SEQ ID NO: 187) (XTEN). Specificity mutants were generated by gibson cloning the appropriate mutants into the dPspCas13b-GSGGGGS (SEQ ID NO: 188) backbone.

The luciferase reporter vector for measuring RNA editing activity was generated by creating a W85X mutation (TGG>TAG) in the luciferase reporter vector used for knockdown experiments. This reporter vector expresses functional Gluc as a normalization control, but a defective Cluc due to the addition of a pretermination site. To test ADAR editing motif preferences, we cloned every possible motif around the adenosine at codon 85 (XAX) of Cluc.

For testing PFS preference of REPAIR, we cloned a pooled plasmid library containing a 6 basepair degenerate PFS sequence upstream of a target region and adenosine editing site. The library was synthesized as an ultramer from Integrated DNA Technologies (IDT) and was made double stranded via annealing a primer and Klenow fragment of DNA polymerase I (New England Biolabs) fill in of the sequence. This dsDNA fragment containing the degenerate sequence was then gibson cloned into the digested reporter vector and this was then isopropanol precipitated and purified. The cloned library was then electroporated into Endura competent *E. coli* cells (Lucigen) and plated on 245 mm×245 mm square bioassay plates (Nunc). After 16 hours, colonies were harvested and midiprepped using endotoxin-free MACHEREY-NAGEL midiprep kits. Cloned libraries were verified by next generation sequencing.

For cloning disease-relevant mutations for testing REPAIR activity, 34 G>A mutations related to disease pathogenesis as defined in ClinVar were selected and 200 bp regions surrounding these mutations were golden gate cloned between mScarlett and EGFP under a CMV promoter. Two additional G>A mutations in AVPR2 and FANCC were selected for Gibson cloning the whole gene sequence under expression of EF1alpha.

For expression of mammalian guide RNA for REPAIR, the PspCas13b direct repeat sequences were synthesized with golden-gate acceptor sites and cloned under U6 expression via restriction digest cloning. Individual guides were then cloned into this expression backbones by golden gate cloning.

Mammalian Cell Culture

Mammalian cell culture experiments were performed in the HEK293FT line (American Type Culture Collection (ATCC)), which was grown in Dulbecco's Modified Eagle Medium with high glucose, sodium pyruvate, and Gluta-MAX (Thermo Fisher Scientific), additionally supplemented with 1× penicillin-streptomycin (Thermo Fisher Scientific) and 10% fetal bovine serum (VWR Seradigm). Cells were maintained at confluency below 80%.

Unless otherwise noted, all transfections were performed with Lipofectamine 2000 (Thermo Fisher Scientific) in 96-well plates coated with poly-D-lysine (BD Biocoat). Cells were plated at approximately 20,000 cells/well sixteen hours prior to transfection to ensure 90% confluency at the time of transfection. For each well on the plate, transfection plasmids were combined with Opti-MEM I Reduced Serum Medium (Thermo Fisher) to a total of 25 µl. Separately, 24.5 ul of Opti-MEM was combined with 0.5 ul of Lipofectamine 2000. Plasmid and Lipofectamine solutions were then combined and incubated for 5 minutes, after which they were pipetted onto cells.

RNA Knockdown Mammalian Cell Assays

To assess RNA targeting in mammalian cells with reporter constructs, 150 ng of Cas13 construct was co-transfected with 300 ng of guide expression plasmid and 12.5 ng of the knockdown reporter construct. 48 hours post-transfection, media containing secreted luciferase was removed from cells, diluted 1:5 in PBS, and measured for activity with BioLux *Cypridina* and Biolux *Gaussia* luciferase assay kits (New England Biolabs) on a plate reader (Biotek Synergy Neo2) with an injection protocol. All replicates performed are biological replicates.

For targeting of endogenous genes, 150 ng of Cas13 construct was co-transfected with 300 ng of guide expression plasmid. 48 hours post-transfection, cells were lysed and RNA was harvested and reverse transcribed using a previously described modification of the Cells-to-Ct kit (Thermo Fisher Scientific). cDNA expression was measured via qPCR using TaqMan qPCR probes for the KRAS transcript (Thermo Fisher Scientific), GAPDH control probes (Thermo Fisher Scientific), and Fast Advanced Master Mix (Thermo Fisher Scientific). qPCR reactions were read out on a LightCycler 480 Instrument II (Roche), with four 5 ul technical replicates in 384-well format.

Evaluation of RNA Specificity Using Pooled Library of Mismatched Targets

The ability of Cas13 to interfere with the mismatched target library was tested using HEK293FT cells seeded in 6 well plates. ~70% confluent cells were transfected using 2400 ng Cas13 vector, 4800 ng of guide and 240 ng of mismatched target library. 48 hours post transfection, cells were harvested and RNA extracted using the QIAshredder (Qiagen) and the Qiagen RNeasy Mini Kit. 1 ug of extracted RNA was reverse transcribed using the qScript Flex cDNA synthesis kit (Quantabio) following the manufacturer's gene-specific priming protocol and a Gluc specific RT primer. cDNA was then amplified and sequenced on an Illumina NextSeq.

The sequencing was analyzed by counting reads per sequence and depletion scores were calculated by determining the log 2(–read count ratio) value, where read count ratio is the ratio of read counts in the targeting guide condition versus the non-targeting guide condition. This score value represents the level of Cas13 activity on the sequence, with higher values representing stronger depletion and thus higher Cas13 cleavage activity. Separate distributions for the single mismatch and double mismatch sequences were determined and plotted as heatmaps with a depletion score for each mismatch identity. For double mismatch sequences the average of all possible double mismatches at a given position were plotted.

Transcriptome-Wide Profiling of Cas13 in Mammalian Cells by RNA Sequencing

For measurement of transcriptome-wide specificity, 150 ng of Cas13 construct, 300 ng of guide expression plasmid and 15 ng of the knockdown reporter construct were co-transfected; for shRNA conditions, 300 ng of shRNA targeting plasmid, 15 ng of the knockdown reporter construct, and 150 ng of EF1-alpha driven mCherry (to balance reporter load) were co-transfected. 48 hours after transfection, RNA was purified with the RNeasy Plus Mini kit (Qiagen), mRNA was selected for using NEBNext Poly(A) mRNA Magnetic Isolation Module (New England Biolabs) and prepared for sequencing with the NEBNext Ultra RNA Library Prep Kit for Illumina (New England Biolabs). RNA sequencing libraries were then sequenced on a NextSeq (Illumina).

To analyze transcriptome-wide sequencing data, reads were aligned RefSeq GRCh38 assembly using Bowtie and RSEM version 1.2.31 with default parameters. Transcript expression was quantified as log 2(TPM+1), genes were filtered for log 2(TPM+1) >2.5 For selection of differentially expressed genes, only genes with differential changes of >2 or <0.75 were considered. Statistical significance of differential expression was evaluated Student's T-test on three targeting replicates versus non-targeting replicates, and filtered for a false discovery rate of <0.01% by Benjamini-Hochberg procedure.

ADAR RNA Editing in Mammalian Cells Transfections

To assess REPAIR activity in mammalian cells, we transfected 150 ng of REPAIR vector, 300 ng of guide expression plasmid, and 40 ng of the RNA editing reporter. After 48 hours, RNA from cells were harvested and reverse transcribed using a method previously described with a gene specific reverse transcription primer. The extracted cDNA was then subjected to two rounds of PCR to add Illumina adaptors and sample barcodes using NEBNext High-Fidelity 2×PCR Master Mix. The library was then subjected to next generation sequencing on an Illumina NextSeq or MiSeq. RNA editing rates were then evaluated at all adenosine within the sequencing window.

In experiments where the luciferase reporter was targeted for RNA editing, we also harvested the media with secreted luciferase prior to RNA harvest. In this case, because the corrected Cluc might be at low levels, we did not dilute the media. We measured luciferase activity with BioLux Cypridina and Biolux Gaussia luciferase assay kits (New England Biolabs) on a plate reader (Biotek Synergy Neo2) with an injection protocol. All replicates performed are biological replicates.

PFS Binding Mammalian Screen

To determine the contribution of the PFS to editing efficiency, 625 ng of PFS target library, 4.7 ug of guide, and 2.35 ug of REPAIR were co-transfected on HEK293FT cells plated in 225 cm2 flasks. Plasmids were mixed with 33 ul of PLUS reagent (Thermo Fisher Scientific), brought to 533 ul with Opti-MEM, incubated for 5 minutes, combined with 30 ul of Lipofectamine 2000 and 500 ul of Opti-MEM, incubated for an additional 5 minutes, and then pipetted onto cells. 48 hours post-transfection, RNA was harvested with the RNeasy Plus Mini kit (Qiagen), reverse transcribed with qScript Flex (Quantabio) using a gene specific primer, and amplified with two rounds of PCR using NEBNext High-Fidelity 2×PCR Master Mix (New England Biolabs) to add Illumina adaptors and sample barcodes. The library was sequenced on an Illumina NextSeq, and RNA editing rates at the target adenosine were mapped to PFS identity. To increase coverage, the PFS was computationally collapsed to 4 nucleotides. REPAIR editing rates were calculated for each PFS, averaged over biological replicates with non-targeting rates for the corresponding PFS subtracted.

Whole-Transcriptome Sequencing to Evaluate ADAR Editing Specificity

For analyzing off-target RNA editing sites across the transcriptome, we harvested total RNA from cells 48 hours post transfection using the RNeasy Plus Miniprep kit (Qiagen). The mRNA fraction is then enriched using a NEBNext Poly(A) mRNA Magnetic Isolation Module (NEB) and this RNA is then prepared for sequencing using NEBNext Ultra RNA Library Prep Kit for Illumina (NEB). The libraries were then sequenced on an Illumina NextSeq and loaded such that there was at least 5 million reads per sample.

RNA Editing Analysis for Targeted and Transcriptome Wide Experiments

To analyze the transcriptome-wide RNA editing RNA sequencing data, sequence files were randomly downsampled to 5 million reads. An index was generated using the RefSeq GRCh38 assembly with Gluc and Cluc sequences added and reads were aligned and quantified using Bowtie/RSEM version 1.3.0. Alignment BAMs were then sorted and analyzed for RNA editing sites using REDitools [cite] with the following parameters: -t 8 -e -d -1 -U [AG or TC]-p -u -m20 -T6-0 -W -v 1 -n 0.0. Any significant edits found in untransfected or EGFP-transfected conditions were considered to be SNPs or artifacts of the transfection and filtered out from the analysis of off-targets. Off-targets were considered significant if the Fisher's exact test yielded a p-value less than 0.5 and that at least 2 of 3 biological replicates identified the edit site.

For analyzing the predicted variant effects of each off-target, the list of off-target edit sites was analyzed using the variant annotation integrator (genome.ucsc.edu/cgi-bin/hgVai) as part of the UCSC genome browser suite of tools using the SIFT and PolyPhen-2 annotations. To declare whether the off-target genes are oncogenic, a database of oncogenic annotations from the COSMIC catalogue of somatic mutations in cancer (cancer.sanger.ac.uk).

For analyzing whether the REPAIR constructs perturbed RNA levels, the transcript per million (TPM) values output from the RSEM analysis were used for expression counts and transformed to log-space by taking the log 2(TPM+1). To find differentially regulated genes, a Student's t-test was performed on three targeting guide replicates versus three non-targeting guide replicates. The statistical analysis was only performed on genes with log 2(TPM+1) values greater than 2.5 and genes were only considered differentially regulated if they had a fold change greater than 2 or less than 0.8. Genes were reported if they had a false discovery rate of less than 0.01.

Comprehensive Characterization of Cas13 Family Members in Mammalian Cells

Figure 5A:
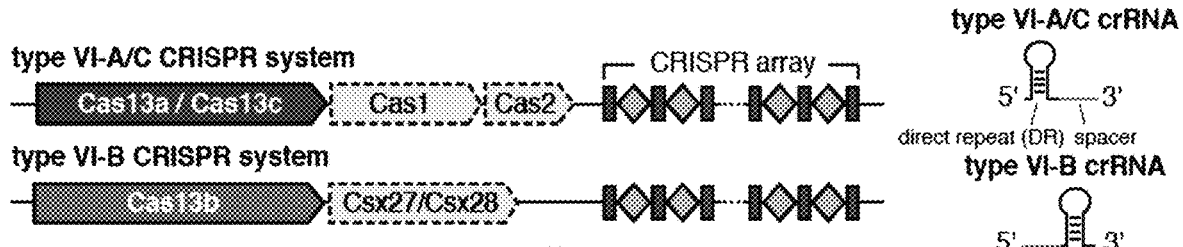
FIG. 5: Characterization of a highly active Cas13b ortholog for RNA knockdown. (A) Schematic of stereotypical Cas13 loci and corresponding crRNA structure. (B) Evaluation of 19 Cas13a, 15 Cas13b, and 7 Cas13c orthologs for luciferase knockdown using two different guides. Orthologs with efficient knockdown using both guides are labeled with their host organism name. (C) PspCas13b and LwaCas13a knockdown activity are compared by tiling guides against Gluc and measuring luciferase expression. (D) PspCas13b and LwaCas13a knockdown activity are compared by tiling guides against Cluc and measuring luciferase expression. (E) Expression levels in log 2(transcripts per million (TPM)) values of all genes detected in RNA-seq libraries of non-targeting control (x-axis) compared to Gluc-targeting condition (y-axis) for LwaCas13a (red) and shRNA (black). Shown is the mean of three biological replicates. The Gluc transcript data point is labeled. (F) Expression levels in log 2(transcripts per million (TPM)) values of all genes detected in RNA-seq libraries of non-targeting control (x-axis) compared to Gluc-targeting condition (y-axis) for PspCas13b (blue) and shRNA (black). Shown is the mean of three biological replicates. The Gluc transcript data point is labeled. (G) Number of significant off-targets from Gluc knockdown for LwaCas13a, PspCas13b, and shRNA from the transcriptome wide analysis in E and F.

We previously developed LwaCas13a for mammalian knockdown applications, but it required an msfGFP stabilization domain for efficient knockdown and, although the specificity was high, knockdown efficiencies were not consistently below 50%(15). We sought to identify a more robust RNA-targeting CRISPR system by characterizing a genetically diverse set of Cas13 family members to assess their RNA knockdown activity in mammalian cells (FIG. 5A). We cloned 21 Cas13a, 15 Cas13b, and 7 Cas13c mammalian codon-optimized orthologs (Table 4) into an expression vector with N- and C-terminal nuclear export signal (NES) sequences and a C-terminal msfGFP to enhance protein stability. To assay interference in mammalian cells, we designed a dual reporter construct expressing the orthogonal Gaussia (Gluc) and Cypridina (Cluc) luciferases under separate promoters, which allows one luciferase to function as a measure of Cas13 interference activity and the other to serve as an internal control. For each ortholog, we designed PFS-compatible guide RNAs, using the Cas13b PFS motifs derived from an ampicillin interference assay (FIG. 11; Table 5) and the 3' H PFS from previous reports of Cas13a activity(10).

Figure 5B:
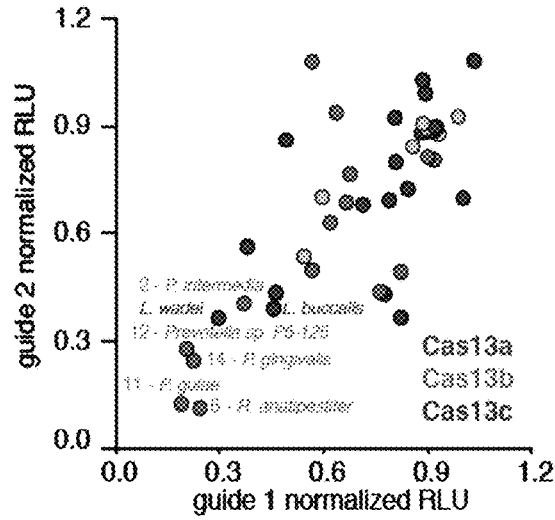

We transfected HEK293FT cells with Cas13 expression, guide RNA and reporter plasmids and quantified levels of the targeted Gluc 48 hours later. Testing two guide RNAs for each Cas13 ortholog revealed a range of activity levels, including five Cas13b orthologs with similar or increased interference across both guide RNAs relative to the recently characterized LwaCas13a (FIG. 5B). We selected these five Cas13b orthologs, as well as the top two Cas13a orthologs for further engineering.

We next tested for Cas13-mediated knockdown of Gluc without msfGFP, in order to select orthologs that do not require stabilization domains for robust activity. We hypothesized that, in addition to msfGFP, Cas13 activity could be affected by subcellular localization, as previously reported for optimization of LwaCas13a(15). Therefore, we tested the interference activity of the seven selected Cas13 orthologs C-terminally fused to one of six different localization tags without msfGFP. Using the luciferase reporter assay, we found that PspCas13b and PguCas13b C-terminally fused to the HIV Rev gene NES and RanCas13b C-terminally fused to the MAPK NES had the highest levels of interference activity (FIG. 12A). To further distinguish activity levels of the top orthologs, we compared the three optimized Cas13b constructs to the optimal LwaCas13a-msfGFP fusion and shRNA for their ability to knockdown the KRAS transcript using position-matched guides (FIG. 12B). We observed the highest levels interference for PspCas13b (average knockdown 62.9%) and thus selected this for further comparison to LwaCas13a.

Figure 5C:
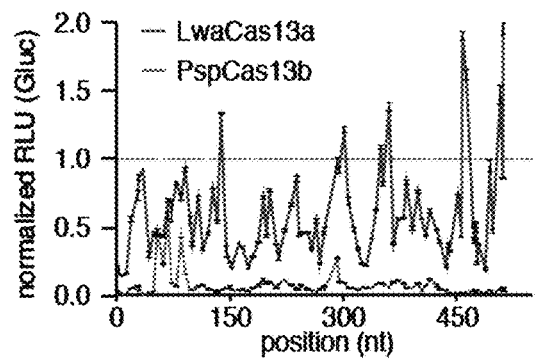
Figure 5D:
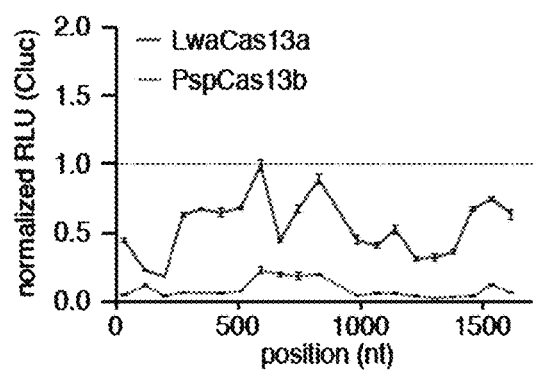

To more rigorously define the activity level of PspCas13b and LwaCas13a we designed position matched guides tiling along both Gluc and Cluc and assayed their activity using our luciferase reporter assay. We tested 93 and 20 position matched guides targeting Gluc and Cluc, respectively, and found that PspCas13b had consistently increased levels of knockdown relative to LwaCas13a (average of 92.3% for PspCas13b vs. 40.1% knockdown for LwaCas13a) (FIG. 5C,D).

Specificity of Cas13 Mammalian Interference Activity

To characterize the interference specificities of PspCas13b and LwaCas13a we designed a plasmid library of luciferase targets containing single mismatches and double mismatches throughout the target sequence and the three flanking 5' and 3' base pairs (FIG. 12C). We transfected HEK293FT cells with either LwaCas13a or PspCas13b, a fixed guide RNA targeting the unmodified target sequence, and the mismatched target library corresponding to the appropriate system. We then performed targeted RNA sequencing of uncleaved transcripts to quantify depletion of mismatched target sequences. We found that LwaCas13a and PspCas13b had a central region that was relatively intolerant to single mismatches, extending from base pairs 12-26 for the PspCas13b target and 13-24 for the LwaCas13a target (FIG. 12D). Double mismatches were even less tolerated than single mutations, with little knockdown activity observed over a larger window, extending from base pairs 12-29 for PspCas13b and 8-27 for LwaCas13a in their respective targets (FIG. 12E). Additionally, because there are mismatches included in the three nucleotides flanking the 5' and 3' ends of the target sequence, we could assess PFS constraints on Cas13 knockdown activity. Sequencing showed that almost all PFS combinations allowed robust knockdown, indicating that a PFS constraint for interference in mammalian cells likely does not exist for either enzyme tested. These results indicate that Cas13a and Cas13b display similar sequence constraints and sensitivities against mismatches.

We next characterized the interference specificity of PspCas13b and LwaCas13a across the mRNA fraction of the transcriptome. We performed transcriptome-wide mRNA sequencing to detect significant differentially expressed genes. LwaCas13a and PspCas13b demonstrated robust knockdown of Gluc (FIG. 5E,F) and were highly specific compared to a position-matched shRNA, which showed hundreds of off-targets (FIG. 5G).

Cas13-ADAR Fusions Enable Targeted RNA Editing

Given that PspCas13b achieved consistent, robust, and specific knockdown of mRNA in mammalian cells, we envisioned that it could be adapted as an RNA binding platform to recruit the deaminase domain of ADARs ($ADAR_{DD}$) for programmable RNA editing. To engineer a PspCas13b lacking nuclease activity (dPspCas13b, referred to as dCas13b from here), we mutated conserved catalytic residues in the HEPN domains and observed loss of luciferase RNA knockdown activity (FIG. 13A). We hypothesized that a dCas13b-$ADAR_{DD}$ fusion could be recruited by a guide RNA to target adenosines, with the hybridized RNA creating the required duplex substrate for ADAR activity (FIG. 6A). To enhance target adenosine deamination rates we introduced two additional modifications to our initial RNA editing design: we introduced a mismatched cytidine opposite the target adenosine, which has been previously reported to increase deamination frequency, and fused dCas13b with the deaminase domains of human ADAR1 or ADAR2 containing hyperactivating mutations to enhance catalytic activity ($ADAR1_{DD}$(E1008Q)(25) or $ADAR2_{DD}$(E488Q)(19)).

To test the activity of dCas13b-$ADAR_{DD}$ we generated an RNA-editing reporter on Cluc by introducing a nonsense mutation (W85X (UGG→UAG)), which could functionally be repaired to the wildtype codon through A→I editing (FIG. 6B) and then be detected as restoration of Cluc luminescence. We evenly tiled guides with spacers 30, 50, 70 or 84 nucleotides in length across the target adenosine to determine the optimal guide placement and design (FIG. 6C). We found that dCas13b-$ADAR1_{DD}$ required longer guides to repair the Cluc reporter, while dCas13b-$ADAR2_{DD}$ was functional with all guide lengths tested (FIG. 6C). We also found that the hyperactive E488Q mutation improved editing efficiency, as luciferase restoration with the wildtype $ADAR2_{DD}$ was reduced (FIG. 13B). From this demonstration of activity, we chose dCas13b-$ADAR2_{DD}$(E488Q) for further characterization and designated this approach as RNA Editing for Programmable A to I Replacement version 1 (REPAIRv1).

To validate that restoration of luciferase activity was due to bona fide editing events, we measured editing of Clue transcripts subject to REPAIRv1 directly via reverse transcription and targeted next-generation sequencing. We tested 30- and 50-nt spacers around the target site and found that both guide lengths resulted in the expected A to I edit, with 50-nt spacers achieving higher editing percentages (FIG. 6D,E, FIG. 13C). We also observed that 50-nt spacers had an increased propensity for editing at non-targeted adenosines, likely due to increased regions of duplex RNA (FIG. 6E, FIG. 13C).

We next targeted an endogenous gene, PPIB. We designed 50-nt spacers tiling PPIB and found that we could edit the PPIB transcript with up to 28% editing efficiency (FIG. 13D). To test if REPAIR could be further optimized, we modified the linker between dCas13b and $ADAR2_{DD}$ (E488Q) (FIG. 13E, Table 6) and found that linker choice modestly affected luciferase activity restoration.

Defining the Sequence Parameters for RNA Editing

Given that we could achieve precise RNA editing at a test site, we wanted to characterize the sequence constraints for programming the system against any RNA target in the transcriptome. Sequence constraints could arise from dCas13b targeting limitations, such as the PFS, or from ADAR sequence preferences(26). To investigate PFS constraints on REPAIRv1, we designed a plasmid library carrying a series of four randomized nucleotides at the 5' end of a target site on the Cluc transcript (FIG. 7A). We targeted the center adenosine within either a UAG or AAC motif and found that for both motifs, all PFSs demonstrated detectable levels of RNA editing, with a majority of the PF Ss having greater than 50% editing at the target site (FIG. 7B). Next, we sought to determine if the $ADAR2_{DD}$ in REPAIRv1 had any sequence constraints immediately flanking the targeted base, as has been reported previously for $ADAR2_{DD}$(26). We tested every possible combination of 5' and 3' flanking nucleotides directly surrounding the target adenosine (FIG. 7C) and found that REPAIRv1 was capable of editing all motifs (FIG. 7D). Lastly, we analyzed whether the identity of the base opposite the target A in the spacer sequence affected editing efficiency and found that an A-C mismatch had the highest luciferase restoration with A-G, A-U, and A-A having drastically reduced REPAIRv1 activity (FIG. 13F).

Correction of Disease-Relevant Human Mutations Using REPAIRv1

Figure 8A:
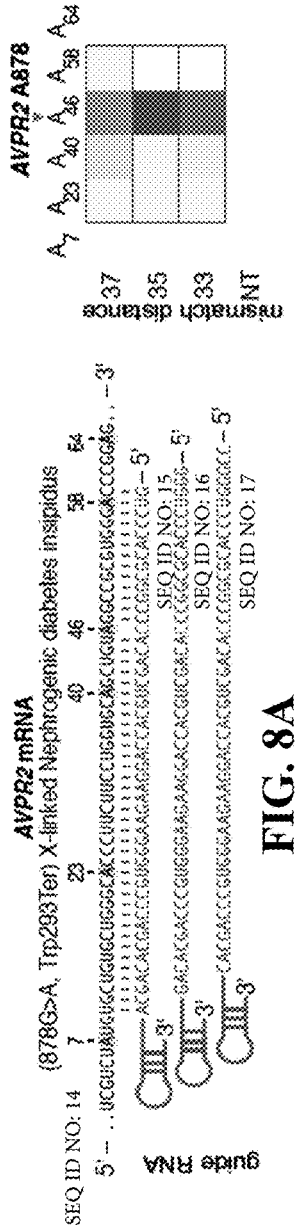
FIG. 8: Correction of disease-relevant mutations with REPAIRv1. (A) Schematic of target and guide design for targeting AVPR2 878G>A. (B) The 878G>A mutation in AVPR2 is corrected to varying percentages using REPAIRv1 with three different guide designs. (C) Schematic of target and guide design for targeting FANCC 1517G>A. (D) The 1517G>A mutation in FANCC is corrected to varying percentages using REPAIRv1 with three different guide designs. (E) Quantification of the percent editing of 34 different disease-relevant G>A mutations using REPAIRv1. (F) Analysis of all the possible G>A mutations that could be corrected as annotated by the ClinVar database. (G) The distribution of editing motifs for all G>A mutations in ClinVar is shown versus the editing efficiency by REPAIRv1 per motif as quantified on the Gluc transcript.
Figure 8B:
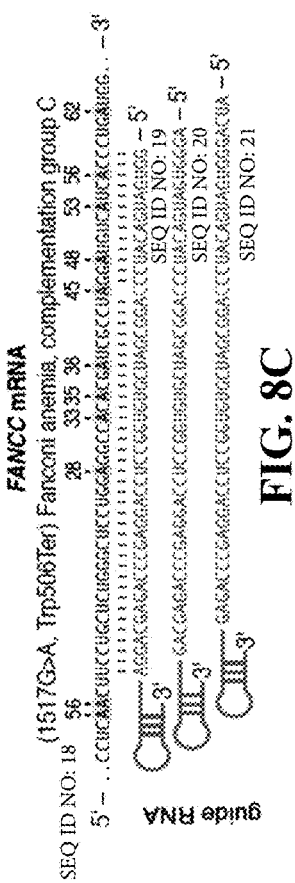
Figure 8C:
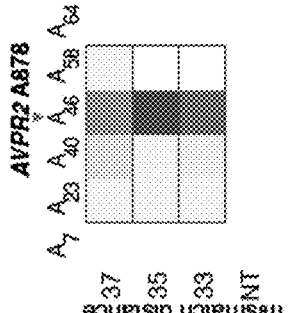
Figure 8D:
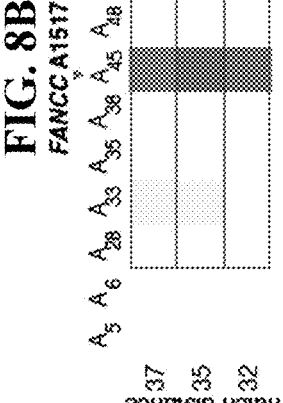
Figure 8E:
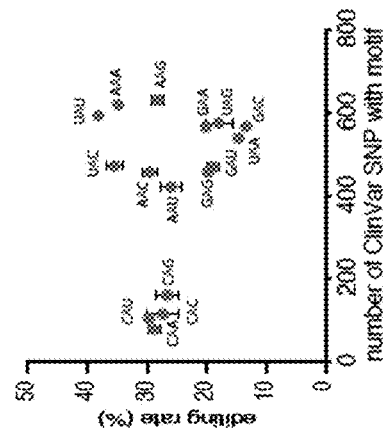
Figure 8F:
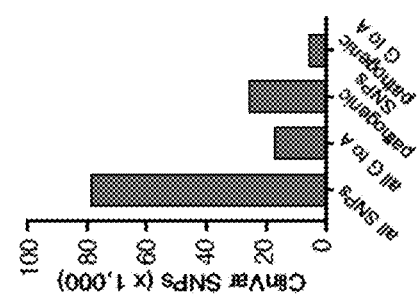
Figure 8G:
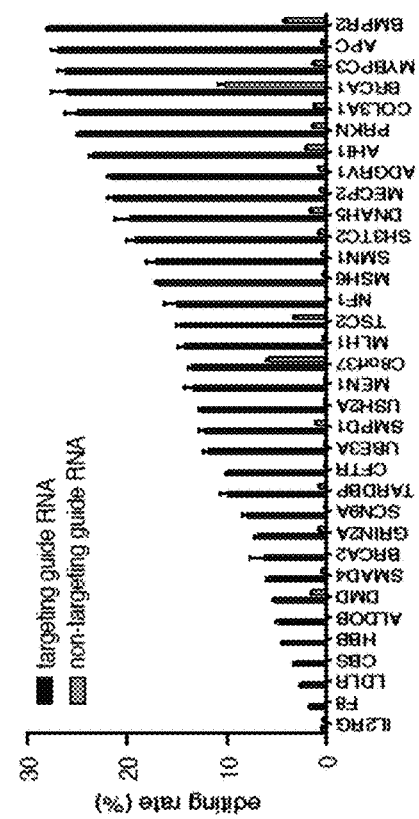
Figure 14:
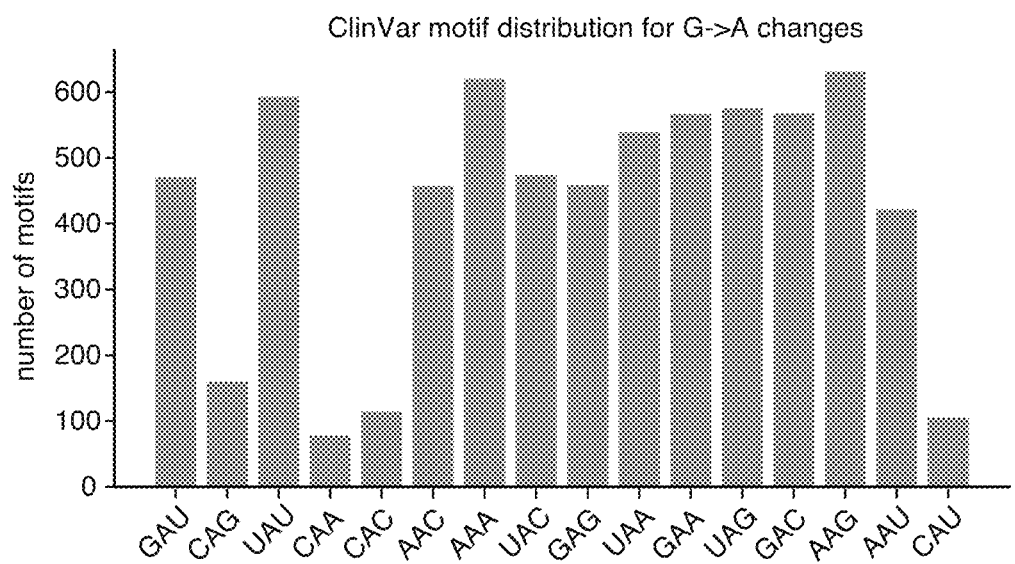
FIG. 14: ClinVar motif distribution for G>A mutations. The number of each possible triplet motif observed in the ClinVar database for all G>A mutations.

To demonstrate the broad applicability of the REPAIRv1 system for RNA editing in mammalian cells, we designed REPAIRv1 guides against two disease relevant mutations: 878G>A (AVPR2 W293X) in X-linked Nephrogenic diabetes insipidus and 1517G>A (FANCC W506X) in Fanconi anemia. We transfected expression constructs for cDNA of genes carrying these mutations into HEK293FT cells and tested whether REPAIRv1 could correct the mutations. Using guide RNAs containing 50-nt spacers, we were able to achieve 35% correction of AVPR2 and 23% correction of FANCC (FIG. 8A-D). We then tested the ability of REPAIRv1 to correct 34 different disease-relevant G>A mutations (Table 7) and found that we were able to achieve significant editing at 33 sites with up to 28% editing efficiency (FIG. 8E). The mutations we chose are only a fraction of the pathogenic G to A mutations (5,739) in the ClinVar database, which also includes an additional 11,943 G to A variants (FIG. 8F and FIG. 14). Because there are no sequence constraints, REPAIRv1 is capable of potentially editing all these disease relevant mutations, especially given that we observed significant editing regardless of the target motif (FIG. 7C and FIG. 8G).

Figure 15A:
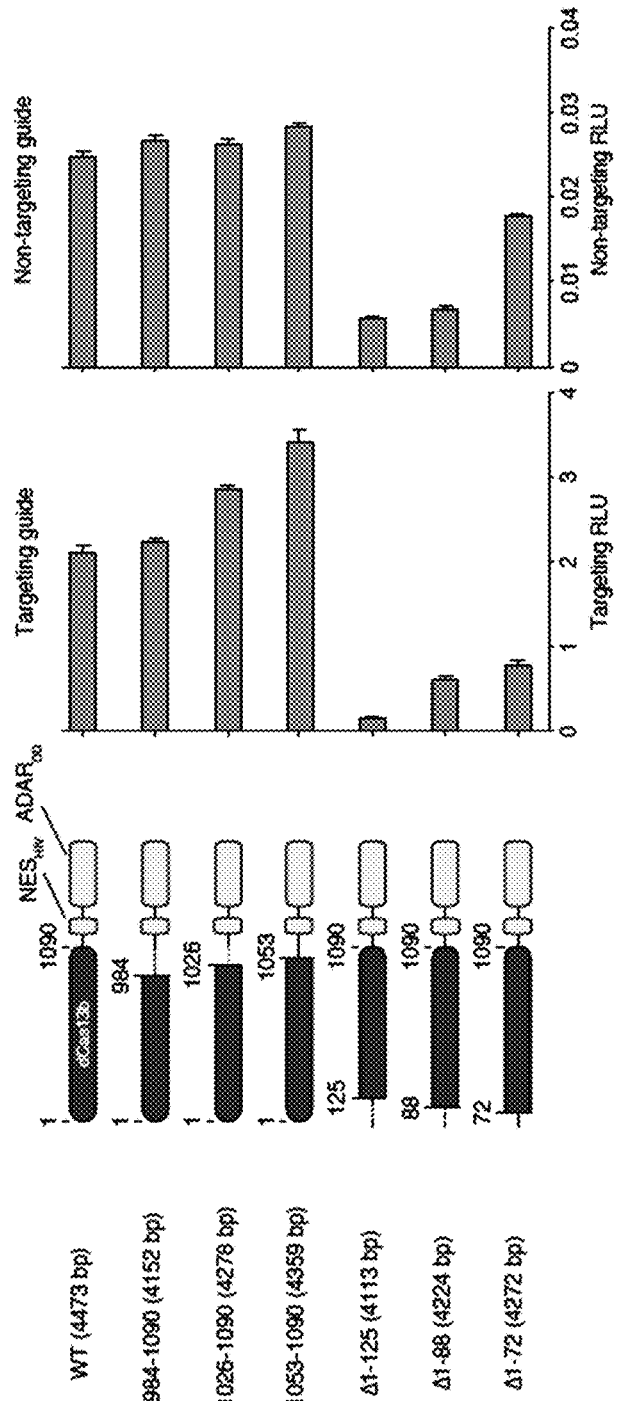
FIG. 15: (A) Truncations of dCas13b still have functional RNA editing. Various N-terminal and C-terminal truncations of dCas13b allow for RNA editing as measured by restoration of luciferase signal.
Figure 15B:
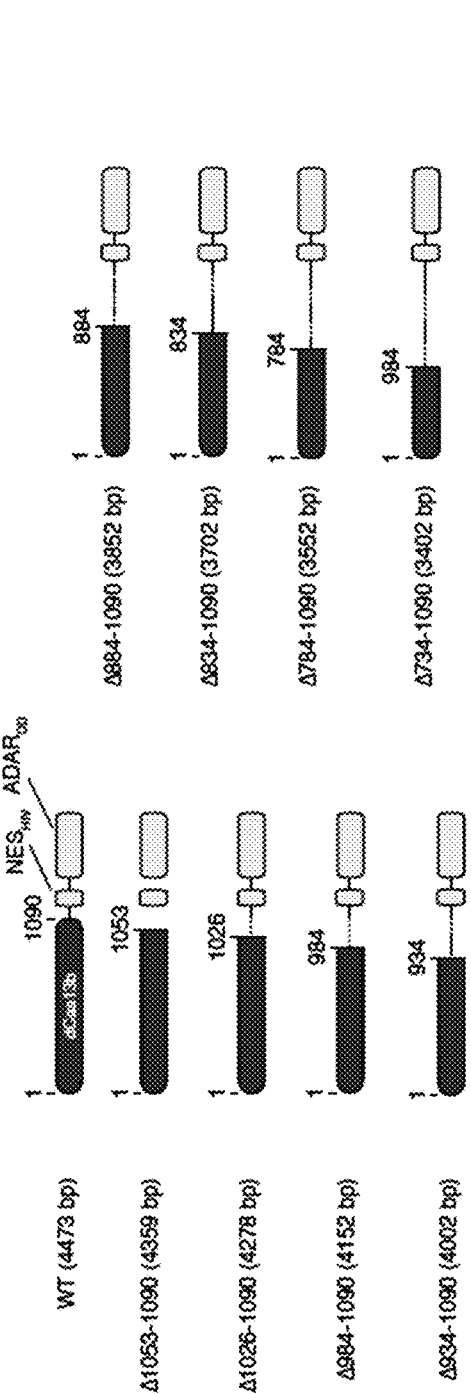

Delivering the REPAIRv1 system to diseased cells is a prerequisite for therapeutic use, and we therefore sought to design REPAIRv1 constructs that could be packaged into therapeutically relevant viral vectors, such as adeno-associated viral (AAV) vectors. AAV vectors have a packaging limit of 4.7 kb, which cannot accommodate the large size of dCas13b-ADAR$_{DD}$ (4473 bp) along with promoter and expression regulatory elements. To reduce the size, we tested a variety of N-terminal and C-terminal truncations of dCas13 fused to ADAR2$_{DD}$(E488Q) for RNA editing activity. We found that all C-terminal truncations tested were still functional and able to restore luciferase signal (FIG. 15), and the largest truncation, C-terminal A984-1090 (total size of the fusion protein 4,152 bp) was small enough to fit within the packaging limit of AAV vectors.

Transcriptome-Wide Specificity of REPAIRv1

Figure 9A:
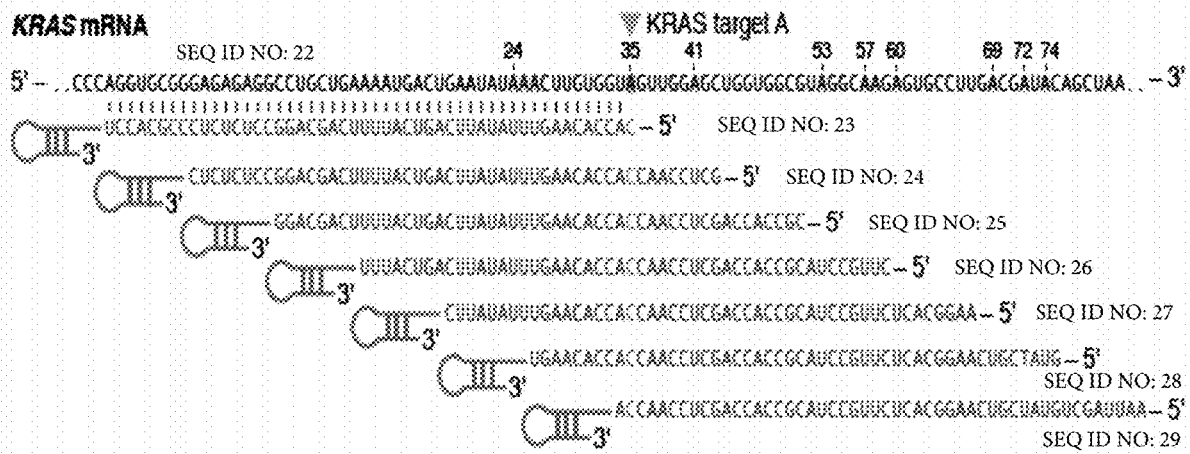
FIG. 9: Characterizing specificity of REPAIRv1. (A) Schematic of KRAS target site and guide design. (B) Quantification of percent editing for tiled KRAS-targeting guides. Editing percentages are shown at the on-target and neighboring adenosine sites. For each guide, the region of duplex RNA is indicated by a red rectangle. (C) Transcriptome-wide sites of significant RNA editing by REPAIRv1 with Cluc targeting guide. The on-target site Cluc site (254 A>G) is highlighted in orange. (D) Transcriptome-wide sites of significant RNA editing by REPAIRv1 with non-targeting guide.
Figure 9B:
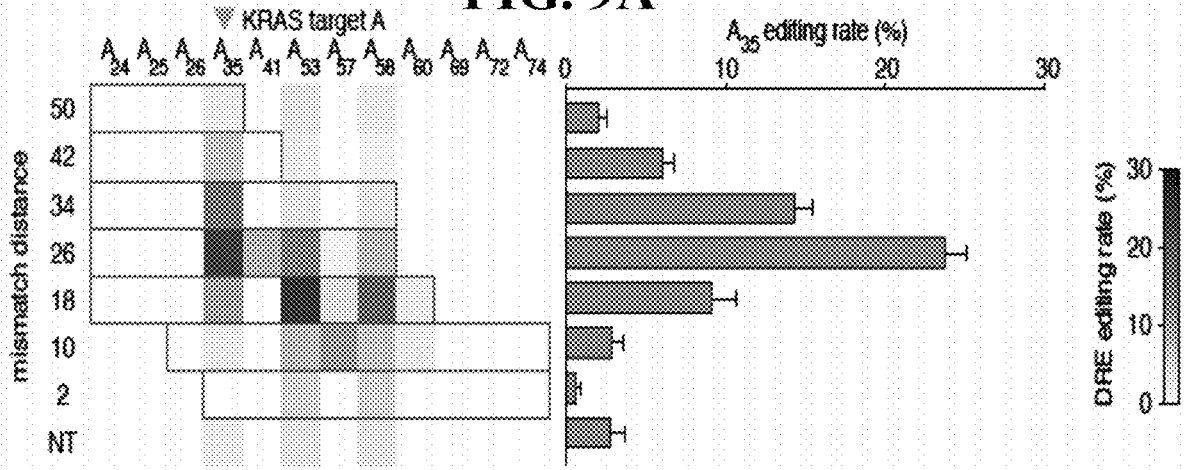

Although RNA knockdown with PspCas13b was highly specific, in our luciferase tiling experiments, we observed off-target adenosine editing within the guide:target duplex (FIG. 6E). To see if this was a widespread phenomenon, we tiled an endogenous transcript, KRAS, and measured the degree of off-target editing near the target adenosine (FIG. 9A). We found that for KRAS, while the on-target editing rate was 23%, there were many sites around the target site that also had detectable A to G edits (FIG. 9B).

Figure 9C:
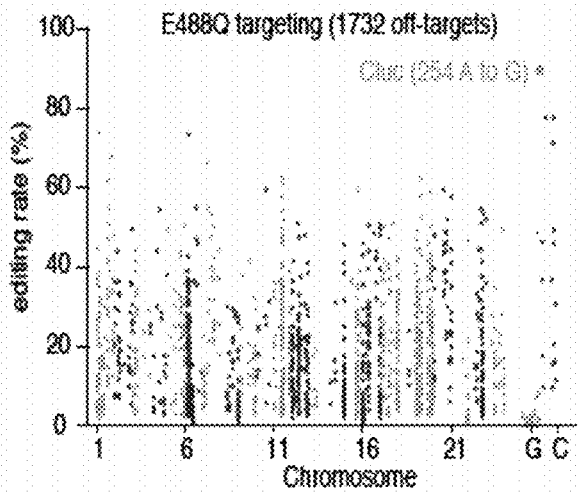
Figure 9D:
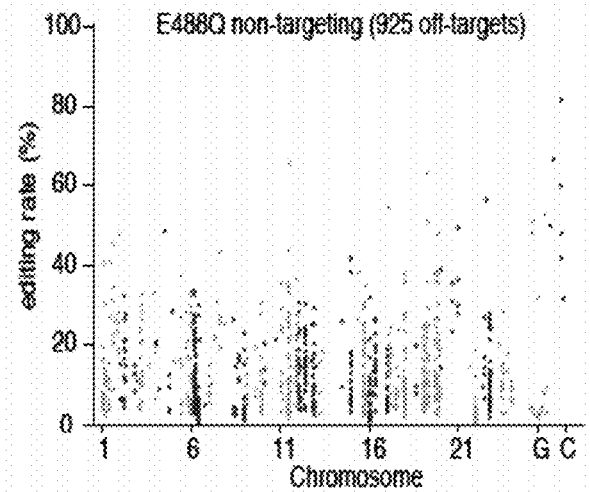

Because of the observed off-target editing within the guide:target duplex, we evaluated all possible transcriptome off-targets by performing RNA sequencing on all mRNAs. RNA sequencing revealed that there was a significant number A to G off-target events, with 1,732 off-targets in the targeting condition and 925 off-targets in the non-targeting condition, with 828 off-targets overlapping (FIG. 9C,D). Of all the editing sites across the transcriptome, the on-target editing site had the highest editing rate, with 89% A to G conversion.

Figure 16A:
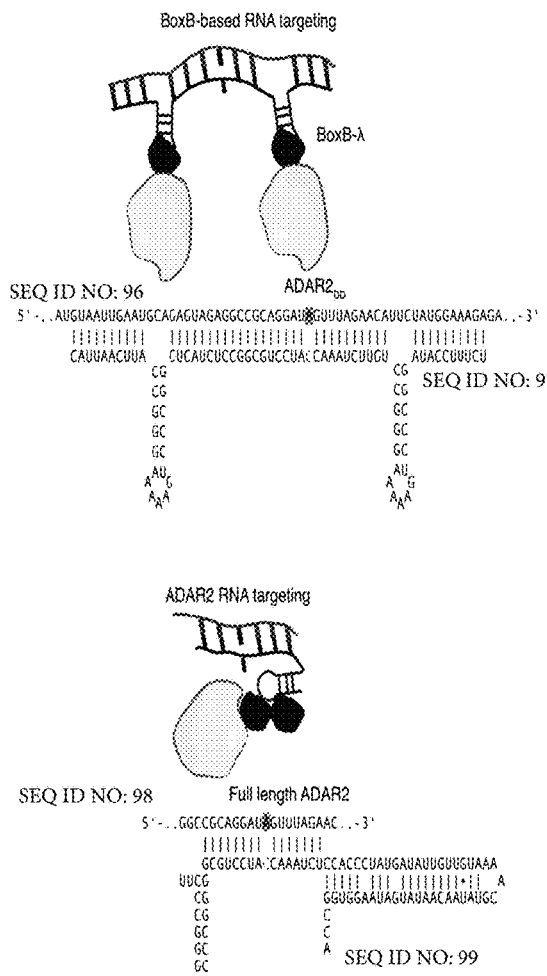
FIG. 16: Comparison of other programmable ADAR systems with the dCas13-ADAR2 editor. (A) Schematic of two programmable ADAR schemes: BoxB-based targeting and full length ADAR2 targeting. In the BoxB scheme (top), the ADAR2 deaminase domain (ADAR2$_{DD}$(E488Q)) is fused to a small bacterial virus protein called lambda N ( λ N), which binds specifically a small RNA sequence called BoxB-λ. A guide RNA containing two BoxB-λ hairpins can then guide the ADAR2$_{DD}$(E488Q), -λ N for site specific editing. In the full length ADAR2 scheme (bottom), the dsRNA binding domains of ADAR2 bind a hairpin in the guide RNA, allowing for programmable ADAR2 editing. (B) Transcriptome-wide sites of significant RNA editing by BoxB-ADAR2$_{DD}$(E488Q) with a guide targeting Cluc and a non-targeting guide. The on-target Cluc site (254 A>G) is highlighted in orange. (C) Transcriptome-wide sites of significant RNA editing by ADAR2 with a guide targeting Cluc and a non-targeting guide. The on-target Cluc site (254 A>G) is highlighted in orange. (D) Transcriptome-wide sites of significant RNA editing by REPAIRv1 with a guide targeting Cluc and a non-targeting guide. The on-target Cluc site (254 A>G) is highlighted in orange. (E) Quantitation of on-target editing rate percentage for BoxB-ADAR2$_{DD}$(E488Q), ADAR2, and REPAIRv1 for targeting guides against Cluc. (F) Overlap of off-target sites between different targeting and non-targeting conditions for programmable ADAR systems.
Figure 16B:
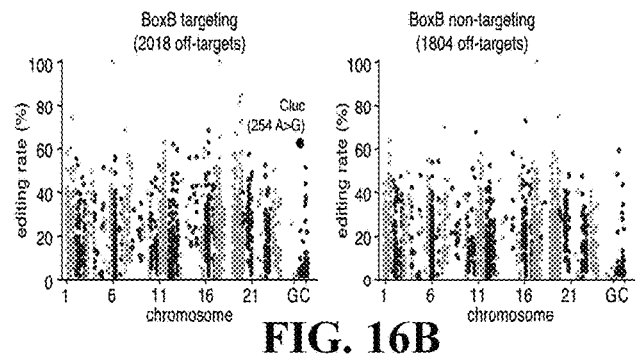
Figure 16C:
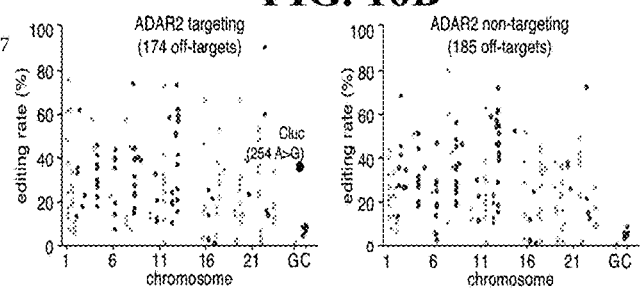
Figure 16D:
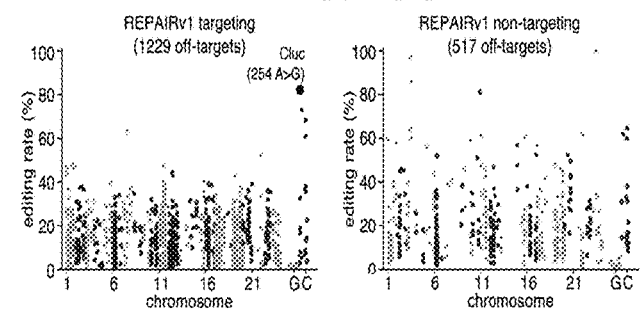
Figure 16E:
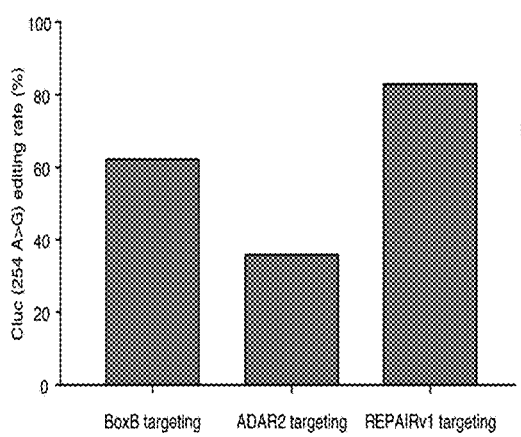
Figure 16F:
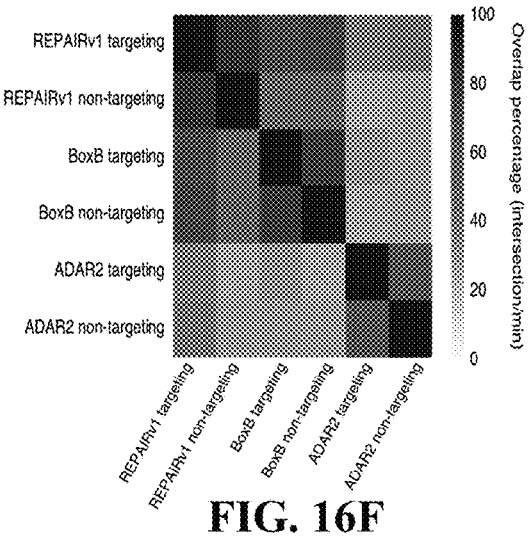

Given the high specificity of Cas13 targeting, we reasoned that the off-targets may arise from ADAR. Two RNA-guided ADAR systems have been described previously (FIG. 16A). The first utilizes a fusion of ADAR2$_{DD}$ to the small viral protein lambda N (λ N), which binds to the BoxB-λ RNA hairpin(22). A guide RNA with double BoxB-k hairpins guides ADAR2DD to edit sites encoded in the guide RNA (23). The second design utilizes full length ADAR2 (ADAR2) and a guide RNA with a hairpin that the double strand RNA binding domains (dsRBDs) of ADAR2 recognize(21, 24). We analyzed the editing efficiency of these two systems compared to REPAIRv1 and found that the BoxB-ADAR2 and ADAR2 systems demonstrated 63% and 36% editing rates, respectively, compared to the 89% editing rate achieved by REPAIRv1 (FIG. 16B-E). Additionally, the BoxB and ADAR2 systems created 2018 and 174 observed off targets, respectively, in the targeting guide conditions, compared to the 1,229 off targets in the REPAIRv1 targeting guide condition. Notably, all the conditions with the two ADAR2$_{DD}$-based systems (REPAIRv1 and BoxB) showed a high percentage of overlap in their off-targets while the ADAR2 system had a largely distinct set of off-targets (FIG. 16F). The overlap in off-targets between the targeting and non-targeting conditions and between REPAIRv1 and BoxB conditions suggest ADAR2$_{DD}$ drove off-targets independent of dCas13 targeting (FIG. 16F).

Improving Specificity of REPAIRv1 Through Rational Protein Engineering

Figure 18A:
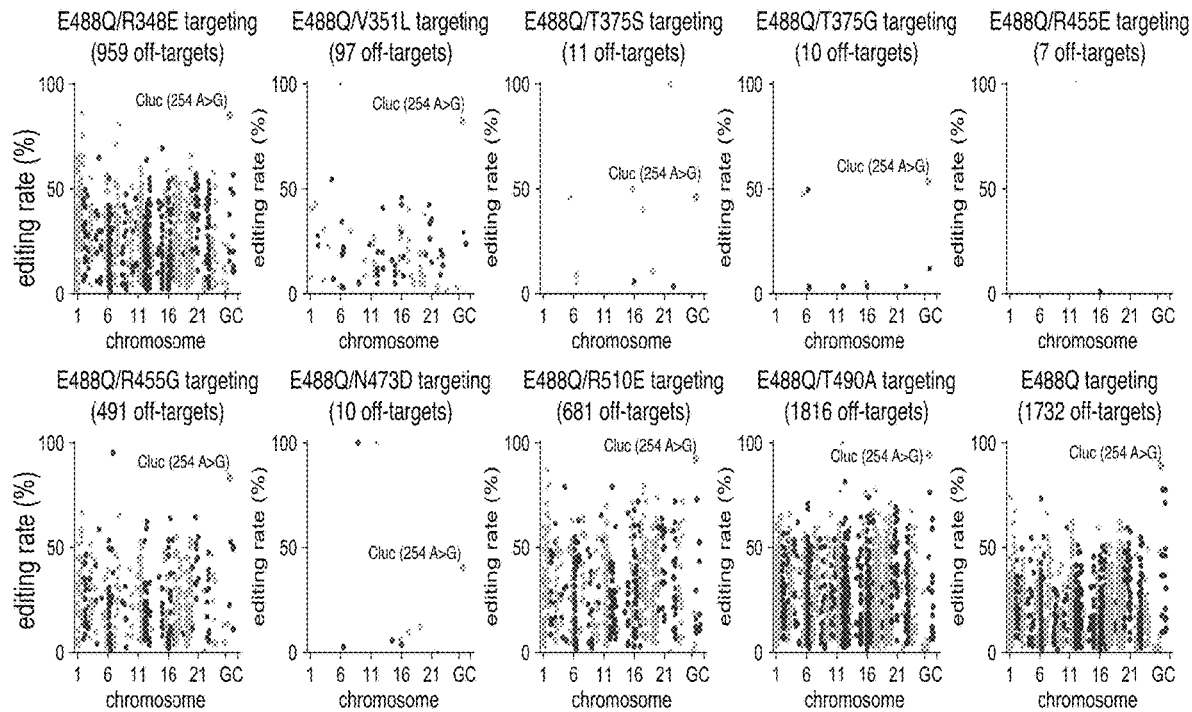
FIG. 18: Transcriptome-wide specificity of RNA editing by dCas13b-ADAR2 D$_D$(E488Q) mutants. (A) Transcriptome-wide sites of significant RNA editing by dCas13b-ADAR2 D$_D$(E488Q) mutants with a guide targeting Cluc. The on-target Cluc site (254 A>G) is highlighted in orange. (B) Transcriptome-wide sites of significant RNA editing by dCas13b-ADAR2 D$_D$(E488Q) mutants with a non-targeting guide.
Figure 18B:
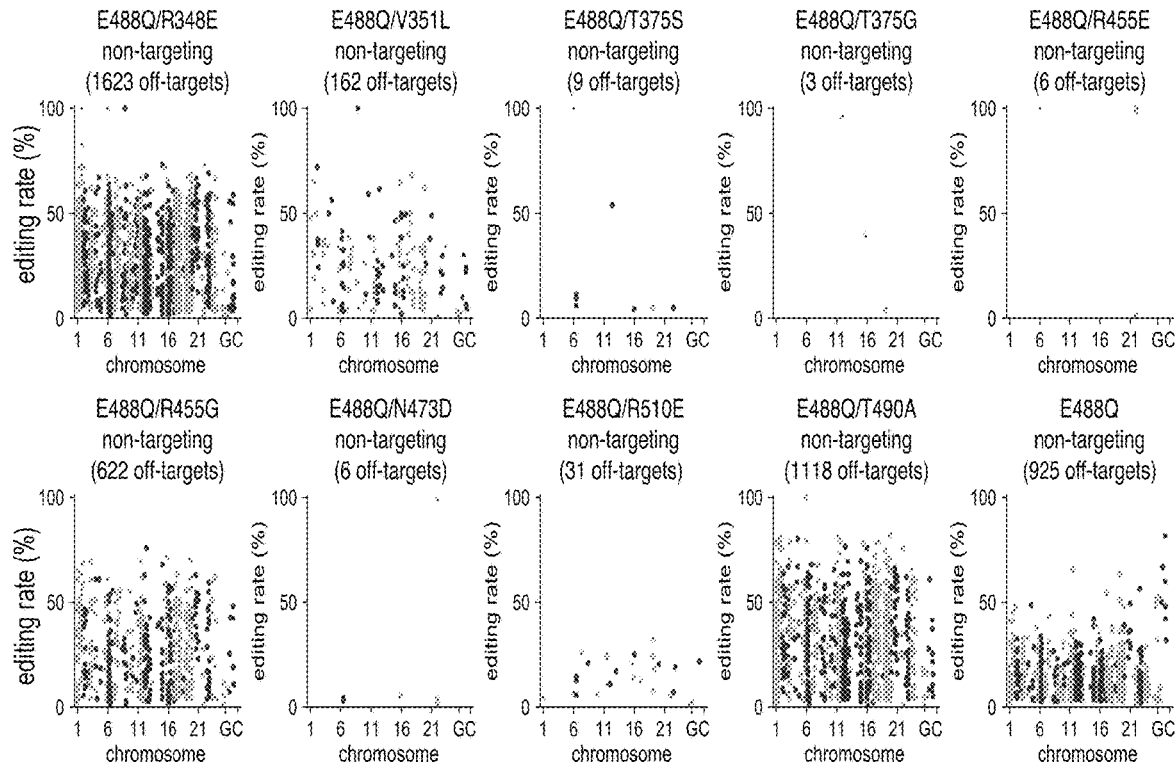

To improve the specificity of REPAIR, we employed structure-guided protein engineering of ADAR2$_{DD}$(E488Q). Because of the guide-independent nature of off-targets, we hypothesized that destabilizing ADAR2$_{DD}$(E488Q)-RNA binding would selectively decrease off-target editing, but maintain on-target editing due to increased local concentration from dCas13b tethering of ADAR2$_{DD}$(E488Q) to the target site. We mutagenized ADAR2$_{DD}$(E488Q) residues previously determined to contact the duplex region of the target RNA (FIG. 10A)(18) on the ADAR2$_{DD}$(E488Q) background. To assess efficiency and specificity, we tested 17 single mutants with both targeting and non-targeting guides, under the assumption that background luciferase restoration in the non-targeting condition detected would be indicative of broader off-target activity. We found that mutations at the selected residues had significant effects on the luciferase activity for targeting and non-targeting guides (FIG. 10A,B, FIG. 17A). A majority of mutants either significantly improved the luciferase activity for the targeting guide or increased the ratio of targeting to non-targeting guide activity, which we termed the specificity score (FIG. 10A,B). We selected a subset of these mutants (FIG. 10B) for transcriptome-wide specificity profiling by next generation sequencing. As expected, off-targets measured from transcriptome-wide sequencing correlated with our specificity score (FIG. 17B) for mutants. We found that with the exception of ADAR2$_{DD}$(E488Q/R455E), all sequenced REPAIRv1 mutants could effectively edit the reporter transcript (FIG. 10C), with many mutants showing reduction in the number of off-targets (FIGS. 17C and 18). We further explored the surrounding motifs of off-targets for specificity mutants, and found that REPAIRv1 and most of the engineered mutants exhibited a strong 3' G preference for their edits, in agreement with the characterized ADAR2 motif (FIG. 19A)(26). We selected the mutant ADAR2$_{DD}$(E488Q/T375G) for future experiments, as it had the highest percent editing of the four mutants with the lowest numbers of transcriptome-wide off targets and termed it REPAIRv2. Compared to REPAIRv1, REPAIRv2 exhibited increased specificity, with a reduction from 1732 to 10 transcriptome off-targets (FIG. 10D). In the region surrounding the targeted adenosine in Cluc, REPAIRv2 had reduced off-target editing, visible in sequencing traces (FIG. 10E). In motifs derived from next-generation sequencing, REPAIRv1 presented a strong preference towards 3' G, but showed off-targeting edits for all motifs (FIG. 19B); by contrast, REPAIRv2 only edited the strongest off-target motifs (FIG. 19C). The distribution of edits on transcripts was heavily skewed, with highly-edited genes having over 60 edits (FIG. 20A,B), whereas REPAIRv2 only edited one transcript (EEF1A1) multiple times (FIG. 20D-F). REPAIRv1 off-target edits were predicted to result in numerous variants, including 1000 missense mutations (FIG. 20C) with 93 oncogenic events (FIG. 20D). In contrast, REPAIRv2 only had 6 missense mutations (FIG. 20E), none of which had oncogenic consequences (FIG. 20F). This reduction in predicted off-target effects distinguishes REPAIRv2 from other RNA editing approaches.

Figure 21A:
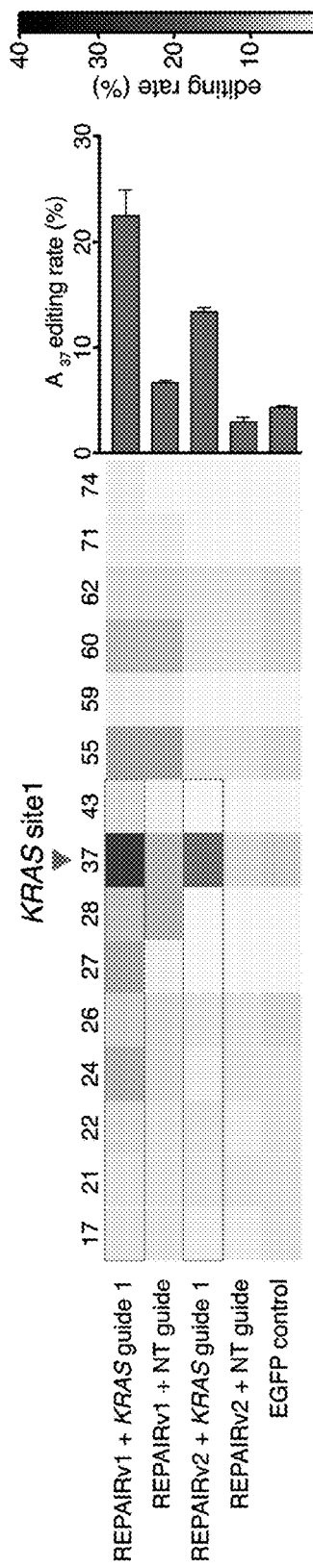
FIG. 21: RNA editing efficiency and specificity of REPAIRv1 and REPAIRv2. (A) Quantification of percent editing of KRAS with KRAS-targeting guide 1 at the targeted adenosine and neighboring sites for REPAIRv1 and REPAIRv2. (B) Quantification of percent editing of KRAS with KRAS-targeting guide 3 at the targeted adenosine and neighboring sites for REPAIRv1 and REPAIRv2. (C) Quantification of percent editing of PPIB with PPIB-targeting guide 2 at the targeted adenosine and neighboring sites for REPAIRv1 and REPAIRv2.
Figure 21B:
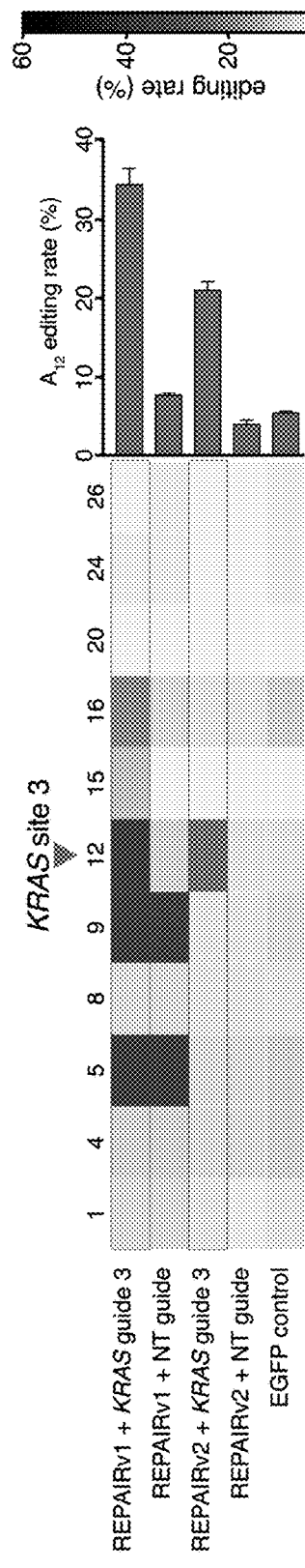
Figure 21C:
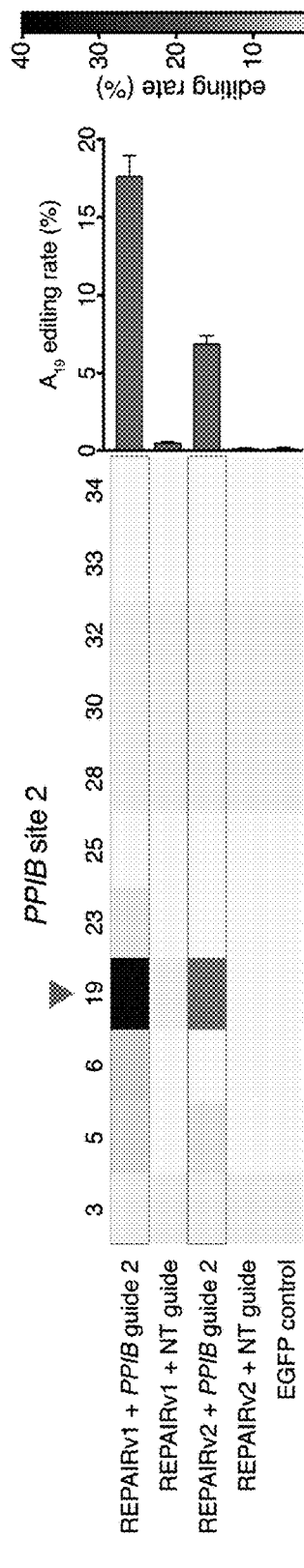

We targeted REPAIRv2 to endogenous genes to test if the specificity-enhancing mutations reduced nearby edits in target transcripts while maintaining high-efficiency on-target editing. For guides targeting either KRAS or PPIB, we found that REPAIRv2 had no detectable off-target edits, unlike REPAIRv1, and could effectively edit the on-target adenosine at 27.1% and 13%, respectively (FIG. 10F,G). This specificity extended to additional target sites, including regions that demonstrate high-levels of background in non-targeting conditions for REPAIRv1, such as other KRAS or PPIB target sites (FIG. 21). Overall, REPAIRv2 eliminated off-targets in duplexed regions around the edited adenosine and showed dramatically enhanced transcriptome-wide specificity.

CONCLUSION

We have shown here that the RNA-guided RNA-targeting type VI-B effector Cas13b is capable of highly efficient and specific RNA knockdown, providing the basis for improved tools for interrogating essential genes and non-coding RNA as well as controlling cellular processes at the transcriptomic level. Catalytically inactive Cas13b (dCas13b) retains programmable RNA binding capability, which we leveraged here by fusing dCas13b to the adenosine deaminase ADAR2 to achieve precise A to I edits, a system we term REPAIRv1 (RNA Editing for Programmable A to I Replacement version 1). Further engineering of the system produced REPAIRv2, a method with comparable or increased activity relative to current editing platforms with dramatically improved specificity.

Although Cas13b exhibits high fidelity, our initial results with dCas13b-ADAR2$_{DD}$ fusions revealed thousands of off-targets. To address this, we employed a rational mutagenesis strategy to vary the ADAR2$_{DD}$ residues that contact the RNA duplex, identifying a variant, ADAR2$_{DD}$(E488Q/T375G), capable of precise, efficient, and highly specific editing when fused to dCas13b. Editing efficiency with this variant was comparable to or better than that achieved with two currently available systems, BoxB-ADAR$_{DD}$ or ADAR2 editing. Moreover, the REPAIRv2 system created only 10 observable off-targets in the whole transcriptome, at least an order of magnitude better than both alternative editing technologies.

The REPAIR system offers many advantages compared to other nucleic acid editing tools. First, the exact target site can be encoded in the guide by placing a cytidine within the guide extension across from the desired adenosine to create a favorable A-C mismatch ideal for ADAR editing activity. Second, Cas13 has no targeting sequence constraints, such as a PFS or PAM, and no motif preference surrounding the target adenosine, allowing any adenosine in the transcriptome to be potentially targeted with the REPAIR system. We do note, however, that DNA base editors can target either the sense or anti-sense strand, while the REPAIR system is limited to transcribed sequences, thereby constraining the total number of possible editing sites we could target. However, due to the more flexible nature of targeting with REPAIR, this system can effect more edits within ClinVar (FIG. 8C) than Cas9-DNA base editors. Third, the REPAIR system directly deaminates target adenosines to inosines and does not rely on endogenous repair pathways, such as base-excision or mismatch repair, to generate desired editing outcomes. Thus, REPAIR should be possible in non-dividing cells that cannot support other forms of editing. Fourth, RNA editing can be transient, allowing the potential for temporal control over editing outcomes. This property will likely be useful for treating diseases caused by temporary changes in cell state, such as local inflammation.

The REPAIR system provides multiple opportunities for additional engineering. Cas13b possesses pre-crRNA processing activity(13), allowing for multiplex editing of multiple variants, which alone might not alter disease risk, but together might have additive effects and disease-modifying potential. Extension of our rational design approach, such as combining promising mutations, could further increase the specificity and efficiency of the system, while unbiased screening approaches could identify additional residues for improving REPAIR activity and specificity.

Currently, the base conversions achievable by REPAIR are limited to generating inosine from adenosine; additional fusions of dCas13 with other catalytic RNA editing domains, such as APOBEC, could enable cytidine to uridine editing. Additionally, mutagenesis of ADAR could relax the substrate preference to target cytidine, allowing for the enhanced specificity conferred by the duplexed RNA substrate requirement to be exploited by C→U editors. Adenosine to inosine editing on DNA substrates may also be possible with catalytically inactive DNA-targeting CRISPR effectors, such as dCas9 or dCpf1, either through formation of DNA-RNA heteroduplex targets(27) or mutagenesis of the ADAR domain.

REPAIR could be applied towards a range of therapeutic indications where A to I (A to G) editing can reverse or slow disease progression (FIG. 22). First, expression of REPAIR for targeting causal, Mendelian G to A mutations in disease-relevant tissues could be used to revert deleterious mutations and treat disease. For example, stable REPAIR expression via AAV in brain tissue could be used to correct the GRIN2A missense mutation c.2191G>A (Asp731Asn) that causes focal epilepsy(28) or the APP missense mutation c.2149G>A (Val717Ile) causing early-onset Alzheimer's disease(29). Second, REPAIR could be used to treat disease by modifying the function of proteins involved in disease-related signal transduction. For instance, REPAIR editing would allow the re-coding of some serine, threonine and tyrosine residues that are the targets of kinases (FIG. 22). Phosphorylation of these residues in disease-relevant proteins affects disease progression for many disorders including Alzheimer's disease and multiple neurodegenerative conditions(30). Third, REPAIR could be used to change the sequence of expressed, risk-modifying G to A variants to pre-emptively decrease the chance of entering a disease state for patients. The most intriguing case are the 'protective' risk-modifying alleles, which dramatically decrease the chance of entering a disease state, and in some cases, confer additional health benefits. For instance, REPAIR could be used to functionally mimic A to G alleles of PCSK9 and IFIH1 that protect against cardiovascular disease and psoriatic arthritis(31), respectively. Last, REPAIR can be used to therapeutically modify splice acceptor and donor sites for exon modulation therapies. REPAIR can change AU to IU or AA to AI, the functional equivalent of the consensus 5' splice donor or 3' splice acceptor sites respectively, creating new splice junctions. Additionally, REPAIR editing can mutate the consensus 3' splice acceptor site from AG-G to promote skipping of the adjacent downstream exon, a therapeutic strategy that has received significant interest for the treatment of DMVD. Modulation of splice sites could have broad applications in diseases where anti-sense oligos have had some success, such as for modulation of SMN2 splicing for treatment of spinal muscular atrophy(32). 007811 We have demonstrated the use of the PspCas13b enzyme as both an RNA knockdown and RNA editing tool. The dCas13b platform for programmable RNA binding has many applications, including live transcript imaging, splicing modification, targeted localization of transcripts, pull down of RNA-binding proteins, and epitranscriptomic modifications. Here, we used dCas13 to create REPAIR, adding to the existing suite of nucleic acid editing technologies. REPAIR provides a new approach for treating genetic disease or mimicking protective alleles, and establishes RNA editing as a useful tool for modifying genetic function.

TABLE 4

Cas13 Orthologs used in this study

| Cas13 ID | Cas13 abbreviation | Host Organism | Protein Accession |
|---|---|---|---|
| Cas13a1 | LshCas13a | Leptotrichia shahii | WP_018451595.1 |
| Cas13a2 | LwaCas13a | Leptotrichia wadei (Lw2) | WP_021746774.1 |
| Cas13a3 | LseCas13a | Listeria seeligeri | WP_012985477.1 |
| Cas13a4 | LbmCas13a | Lachnospiraceae bacterium MA2020 | WP_044921188.1 |
| Cas13a5 | LbnCas13a | Lachnospiraceae bacterium NK4A179 | WP_022785443.1 |
| Cas13a6 | CamCas13a | [Clostridium] aminophilum DSM 10710 | WP_031473346.1 |
| Cas13a7 | CgaCas13a | Carnobacterium gallinarum DSM 4847 | WP_034560163.1 |
| Cas13a8 | Cga2Cas13a | Carnobacterium gallinarum DSM 4847 | WP_034563842.1 |
| Cas13a9 | PprCas13a | Paludibacter propionicigenes WB4 | WP_013443710.1 |
| Cas13a10 | LweCas13a | Listeria weihenstephanensis FSL R9-0317 | WP_036059185.1 |
| Cas13a11 | LbfCas13a | Listeriaceae bacterium FSL M6-0635 | WP_036091002.1 |
| Cas13a12 | Lwa2Cas13a | Leptotrichia wadei F0279 | WP_021746774.1 |
| Cas13a13 | RcsCas13a | Rhodobacter capsulatus SB 1003 | WP_013067728.1 |
| Cas13a14 | RcrCas13a | Rhodobacter capsulatus R121 | WP_023911507.1 |
| Cas13a15 | RcdCas13a | Rhodobacter capsulatus DE442 | WP_023911507.1 |
| Cas13a16 | LbuCas13a | Leptotrichia buccalis C-1013-b | WP_015770004.1 |
| Cas13a17 | HheCas13a | Herbinix hemicellulosilytica | CRZ35554.1 |
| Cas13a18 | EreCas13a | [Eubacterium] rectale | WP_055061018.1 |
| Cas13a19 | EbaCas13a | Eubacteriaceae bacterium CHKCI004 | WP_090127496.1 |
| Cas13a20 | BmaCas13a | Blautia sp. Marseille-P2398 | WP_062808098.1 |
| Cas13a21 | LspCas13a | Leptotrichia sp. oral taxon 879 str. F0557 | WP_021744063.1 |
| Cas13b1 | BzoCas13b | Bergeyella zoohelcum | WP_002664492 |
| Cas13b2 | PinCas13b | Prevotella intermedia | WP_036860899 |
| Cas13b3 | PbuCas13b | Prevotella buccae | WP_004343973 |
| Cas13b4 | AspCas13b | Alistipes sp. ZOR0009 | WP_047447901 |
| Cas13b5 | PsmCas13b | Prevotella sp. MA2016 | WP_036929175 |
| Cas13b6 | RanCas13b | Riemerella anatipestifer | WP_004919755 |
| Cas13b7 | PauCas13b | Prevotella aurantiaca | WP_025000926 |
| Cas13b8 | PsaCas13b | Prevotella saccharolytica | WP_051522484 |
| Cas13b9 | Pin2Cas13b | Prevotella intermedia | WP_061868553 |
| Cas13b10 | CcaCas13b | Capnocytophaga canimorsus | WP_013997271 |
| Cas13b11 | PguCas13b | Porphyromonas gulae | WP_039434803 |
| Cas13b12 | PspCas13b | Prevotella sp. P5-125 | WP_044065294 |
| Cas13b13 | FbrCas13b | Flavobacterium branchiophilum | WP_014084666 |
| Cas13b14 | PgiCas13b | Porphyromonas gingivalis | WP_053344417 |
| Cas13b15 | Pin3Cas13b | Prevotella intermedia | WP_050955369 |
| Cas13c1 | FnsCas13c | Fusobacterium necrophorum subsp. funduliforme ATCC 51357 contig00003 | WP_005959231.1 |
| Cas13c2 | FndCas13c | Fusobacterium necrophorum DJ-2 contig0065, whole genome shotgun sequence | WP_035906563.1 |
| Cas13c3 | FnbCas13c | Fusobacterium necrophorum BFTR-1 contig0068 | WP_035935671.1 |
| Cas13c4 | FnfCas13c | Fusobacterium necrophorum subsp. funduliforme 1_1_36S cont1.14 | EHO19081.1 |
| Cas13c5 | FpeCas13c | Fusobacterium perfoetens ATCC 29250 T364DRAFT_scaffold00009.9_C | WP_027128616.1 |
| Cas13c6 | FulCas13c | Fusobacterium ulcerans ATCC 49185 cont2.38 | WP_040490876.1 |

TABLE 4-continued

Cas13 Orthologs used in this study

| Cas13 ID | Cas13 abbreviation | Host Organism | Protein Accession |
|---|---|---|---|
| Cas13c7 | AspCas13c | *Anaerosalibacter* sp. ND1 genome assembly *Anaerosalibacter massiliensis* ND1 | WP_042678931.1 |

TABLE 5

PFS cutoffs in bacterial screens

| Cas13b ortholog | Key | -Log₂ depletion score used to generate PFS motif |
|---|---|---|
| *Bergeyella zoohelcum* | 1 | 2 |
| *Prevotella intermedia* locus 1 | 2 | 1 |
| *Prevotella buccae* | 3 | 3 |
| *Alistipes* sp. ZOR0009 | 4 | 1 |
| *Prevotella* sp. MA2016 | 5 | 2 |
| *Riemerella anatipestifer* | 6 | 4 |
| *Prevotella aurantiaca* | 7 | 1 |
| *Prevotella saccharolytica* | 8 | 0 |
| *Prevotella intermedia* locus 2 | 9 | 0 |
| *Capnocytophaga canimorsus* | 10 | 3 |
| *Porphyromonas gulae* | 11 | 4 |
| *Prevotella* sp. P5-125 | 12 | 2.1 |
| *Flavobacterium branchiophilum* | 13 | 1 |
| *Porphyromonas gingivalis* | 14 | 3 |
| *Prevotella intermedia* locus 2 | 15 | 4 |

TABLE 6 dCas13b-ADAR linker sequences used in this study for RNA editing in mammalian cells.

| Figure | linker |
|---|---|
| 6C | GSGGGGS (SEQ ID NO: 189) |
| 6E | GS |
| 13B | GSGGGGS (SEQ ID NO: 190) |
| 13C | GS |
| 13D | GS |
| 13E: GS | GS |
| 13E: GSGGGGS | GSGGGGS (SEQ ID NO: 190) |
| 13E: (GGGS)3 | GGGGSGGGGSGGGGS (SEQ ID NO: 191) |
| 13E: Rigid | EAAAK (SEQ ID NO: 192) |
| 13E: (GGS)6 | GGSGGSGGSGGSGGSGGS (SEQ ID NO: 193) |
| 13E: XTEN | SGSETPGTSESATPES (SEQ ID NO: 194) |
| 7B | GS |
| 13F | GS |
| 7C | GS |
| 8B | GS |
| 8D | GS |
| 8E | GS |
| 7A: Δ984-1090, Δ1026-1090, Δ1053-1090 | GS |
| 7A: Δ1-125, Δ1-88, Δ1-72 | GSGGGGS (SEQ ID NO: 190) |
| 9B | GS |
| 9C | GS |
| 9D | GS |
| 16A | GS |
| 16C | GS |
| 16D | GS |
| 17D | GS |
| 10A | GS |
| 18A | GS |
| 10B | GS |
| 18B | GS |
| 18C | GS |
| 19A | GS |
| 19B | GS |
| 10C | GS |
| 10D | GS |
| 10E | GS |
| 10F | GS |
| 22A | GS |
| 22A | GS |

TABLE 7

Disease information for disease-relevant mutations

| Full length candidates | Gene | Disease |
|---|---|---|
| NM_000054.4(AVPR2):c.878G>A (p.Trp293Ter) | AVPR2 | Nephrogenic diabetes insipidus, X-linked |
| NM_000136.2(FANCC):c.1517G>A (p.Trp506Ter) | FANCC | Fanconi anemia, complementation group C |

| Additional simulated candiates Candidate | Gene | Disease |
|---|---|---|
| NM_000206.2(IL2RG):c.710G>A (p.Trp237Ter) | IL2RG | X-linked severe combined immunodeficiency |
| NM_000132.3(F8):c.3144G>A (p.Trp1048Ter) | F8 | Hereditary factor VIII deficiency disease |
| NM_000527.4(LDLR):c.1449G>A (p.Trp483Ter) | LDLR | Familial hypercholesterolemia |
| NM_0000712(CBS):c.162G>A (p.Trp54Ter) | CBS | Homocystinuria due to CBS deficiency |
| NM_000518.4(HBB):c.114G>A (p.Trp38Ter) | HBB | beta^0^ Thalassemia\|beta Thalassemia |
| NM_000035.3(ALDOB):c.888G>A (p.Trp296Ter) | ALDOB | Hereditary fructosuria |
| NM_004006.2(DMD):c.3747G>A (p.Trp1249Ter) | DMD | Duchenne muscular dystrophy |
| NM_005359.5(SMAD4):c.906G>A (p.Trp302Ter) | SMAD4 | Juvenile polyposis syndrome |
| NM_000059.3(BRCA2):c.582G>A (p.Trp194Ter) | BRCA2 | Familial cancer of breast\|Breast-ovarian cancer, familial 2 |
| NM_000833.4(GRIN2A):c.3813G>A (p.Trp1271Ter) | GRIN2A | Epilepsy, focal, with speech disorder and with or without mental retardation |
| NM_002977.3(SCN9A):c.2691G>A (p.Trp897Ter) | SCN9A | Indifference to pain, congenital, autosomal recessive |
| NM_007375.3(TARDBP):c.943G>A (p.Ala315Thr) | TARDBP | Amyotrophic lateral sclerosis type 10 |
| NM_000492.3(CFTR):c.3846G>A (p.Trp1282Ter) | CFTR | Cystic fibrosis\|Hereditary pancreatitis\|not provided\|ataluren response-Efficacy |
| NM_130838.1(UBE3A):c.2304G>A (p.Trp768Ter) | UBE3A | Angelman syndrome |
| NM_000543.4(SMPD1):c.168G>A (p.Trp56Ter) | SMPDI | Niemann-Pick disease, type A |
| NM_206933.2(USH2A):c.9390G>A (p.Trp3130Ter) | USH2A | Usher syndrome, type 2A |
| NM_130799.2(MEN1):c.1269G>A (p.Trp423Ter) | MEN1 | Hereditary cancer-predisposing syndrome |
| NM_177965.3(C8orf37):c.555G>A (p.Trp185Ter) | C8orf37 | Retinitis pigmentosa 64 |
| NM_000249.3(MLH1):c.1998G>A (p.Trp666Ter) | MLH1 | Lynch syndrome |
| NM_000548.4(TSC2):c.2108G>A (p.Trp703Ter) | TSC2 | Tuberous sclerosis 2\|Tuberous sclerosis syndrome |
| NM_000267.3(NF1):c.7044G>A (p.Trp2348Ter) | NF1 | Neurofibromatosis, type 1 |

TABLE 7-continued

Disease information for disease-relevant mutations

| | | |
|---|---|---|
| NM_000179.2(MSH6):c.3020G>A (p.Trp1007Ter) | MSH6 | Lynch syndrome |
| NM_000344.3(SMN1):c.305G>A (p.Trp102Ter) | SMN1 | Spinal muscular atrophy, type II\|Kugelberg-Welander disease |
| NM_024577.3(SH3TC2):c.920G>A (p.Trp307Ter) | SH3TC2 | Charcot-Marie-Tooth disease, type 4C |
| NM_001369.2(DNAH5):c.8465G>A (p.Trp2822Ter) | DNAH5 | Primary ciliary dyskinesia |
| NM_004992.3(MECP2):c.311G>A (p.Trp104Ter) | MECP2 | Rett syndrome |
| NM_032119.3(ADGRV1):c.7406G>A (p.Trp2469Ter) | ADGRV1 | Usher syndrome, type 2C |
| NM_017651,4(AHI1):c.2174G>A (p.Trp725Ter) | AHI1 | Joubert syndrome 3 |
| NM_004562.2(PRKN):c.1358G>A (p.Trp453Ter) | PRKN | Parkinson disease 2 |
| NM_000090.3(COL3A1):c.3833G>A (p.Trp1278Ter) | COL3A1 | Ehlers-Danlos syndrome, type 4 |
| NM_007294.3(BRCA1):c.5511G>A (p.Trp1837Ter) | BRCA1 | Familial cancer of breast\|Breast-ovarian cancer, familial 1 |
| NM_000256.3(MYBPC3):c.3293G>A (p.Trp1098Ter) | MYBPC3 | Primary familial hypertrophic cardiomyopathy |
| NM_000038.5(APC):c.1262G>A (p.Trp421Ter) | APC | Familial adenomatous polyposis 1 |
| NM_001204.6(BMPR2):c.893G>A (P.W298*) | BMPR2 | Primary pulmonary hypertension |

TABLE 8

Key plasmids used in this study

| Plasmid name | Description |
|---|---|
| pAB0006 | CMV-Cluciferase-polyA EF1a-G-luciferase-poly A |
| pAB0040 | CMV-Cluciferase(STOP85)-polyA EF1a-G-luciferase-polyA |
| pAB0048 | pCDNA-ADAR2-N-terminal B12-HIV NES |
| pAB0050 | pAB0001-A02 (crRNA backbone) |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0014.B6 | EF1a-BsiWI-Cas13b6-NES-mapk |
| pAB0013.B11 | EF1a-BsiWI-Cas13b11-NES-HIV |
| pAB0013.B12 | EF1a-BsiWI-Cas13b12-NES-HIV |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0079 | pCDNA-ADAR1hu-EQmutant-N-terminal destination vector |
| pAB0085 | pCDNA-ADAR2 (E488Q)hu-EQmutant-N-terminal destination vector |
| pAB0095 | EF1a-BsiWI-Cas13-B12-NES-HIV, with double H HEPN mutant |
| pAB0114 | pCDNA-wtADAR2hu-EQmutant-N-terminal destination vector |
| pAB0120 | Luciferase ADAR guide optimal (guide 24 from wC0054) |
| pAB0122 | pAB0001-B12 NT guide for ADAR experiments |
| pAB0151 | pCDNA-ADAR2hu-EQmutant-N-terminal destination vector C-term delta 984-1090 |
| pAB0180 | T375G specificity mutant |
| pAB0181 | T375G Cas13b C-term delta 984-1090 |

TABLE 9

Guide/shRNA sequences used in this study for knockdown in mammalian cells

| Name | Spacer sequence | Interference Mechanism | Notes | First FIG. |
|---|---|---|---|---|
| Bacterial PFS guide | GCCAGCUUUCCGGGCAUGGCUUCCAUC (SEQ ID NO: 195) | Cas13b | Used for all orthologs | |

TABLE 9-continued

Guide/shRNA sequences used in this study
for knockdown in mammalian cells

Figure 5E:
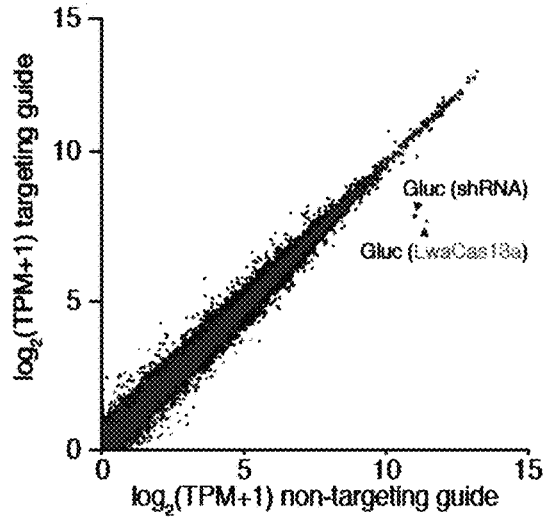

| Name | Spacer sequence | Interference Mechanism | Notes | First FIG. |
|---|---|---|---|---|
| Cas13a-Gluc guide 1 | GCCAGCTTTCCGGGCATTGG CTTCCATC (SEQ ID NO: 196) | Cas13a | Used for all Cas13a orthologs | FIG. 5B |
| Cas13a-Gluc guide 2 | ACCCAGGAATCTCAGGAATG TCGACGAT (SEQ ID NO: 197) | Cas13a | Used for all Cas13a orthologs | FIG. 5B |
| Cas13a-non-targeting guide (LacZ) | AGGGTTTTCCCAGTCACGAC GTTGTAAA (SEQ ID NO: 198) | Cas13a | Used for all Cas13a orthologs | FIG. 5B |
| Cas13b-Gluc guide 1.1 | GGGCAUUGGCUUCCAUCUCUU UGAGCACCU (SEQ ID NO: 199) | Cas13b | Used for orthologs 1-3, 6, 7, 10, 11, 12, 14, 15 | FIG. 5B |
| Cas13b-Gluc guide 1.2 | GUGCAGCCAGCUUUCCGGGC AUUGGCUUCC (SEQ ID NO: 200) | Cas13b | Used for ortholog 4 | FIG. 5B |
| Cas13b-Gluc guide 1.3 | GCAGCCAGCUUUCCGGGCAU UGGCUUCCAU (SEQ ID NO: 201) | Cas13b | Used for ortholog 5 | FIG. 5B |
| Cas13b-Gluc guide 1.4 | GGCUUCCAUCUCUUUGAGCA CCUCCAGCGG (SEQ ID NO: 202) | Cas13b | Used for ortholog 8, 9 | FIG. 5B |
| Cas13b-Gluc guide 1.5 | GGAAUGUCGACGAUCGCCUC GCCUAUGCCG (SEQ ID NO: 203) | Cas13b | Used for ortholog 13 | FIG. 5B |
| Cas13b-Gluc guide 2.1 | GAAUGUCGACGAUCGCCUCG CCUAUGCCGC (SEQ ID NO: 204) | Cas13b | Used for orthologs 1-3, 6, 7, 10, 11, 14, 15 | FIG. 5B |
| Cas13b-Gluc guide 2.2 | GACCUGUGCGAUGAACUGCU CCAUGGGCUC (SEQ ID NO: 205) | Cas13b | Used for ortholog 12 | FIG. 5B |
| Cas13b-Gluc guide 2.2 | GUGUGGCAGCGUCCUGGGA UGAACUUCUUC (SEQ ID NO: 206) | Cas13b | Used for ortholog 4 | FIG. 5B |
| Cas13b-Gluc guide 2.3 | GUGGCAGCGUCCUGGGAUG AACUUCUUCAU (SEQ ID NO: 207) | Cas13b | Used for ortholog 5 | FIG. 5B |
| Cas13b-Gluc guide 2.4 | GCUUCUUGCCGGGCAACUUC CCGCGGUCAG (SEQ ID NO: 208) | Cas13b | Used for ortholog 8, 9 | FIG. 5B |
| Cas13b-Gluc guide 2.6 | GCAGGGUUUUCCCAGUCACG ACGUUGUAAAA (SEQ ID NO: 209) | Cas13b | Used for ortholog 13 | FIG. 5B |
| Cas13b-non targeting guide | GCAGGGUUUUCCCAGUCACG ACGUUGUAAAA (SEQ ID NO: 210) | Cas13b | Used for all orthologs | FIG. 5B |
| Cas13a-Gluc guide-RNASeq | ACCCAGGAAUCUCAGGAAUG UCGACGAU (SEQ ID NO: 211) | Cas13a | | FIG. 5E |

TABLE 9-continued

Guide/shRNA sequences used in this study for knockdown in mammalian cells

Figure 5F:
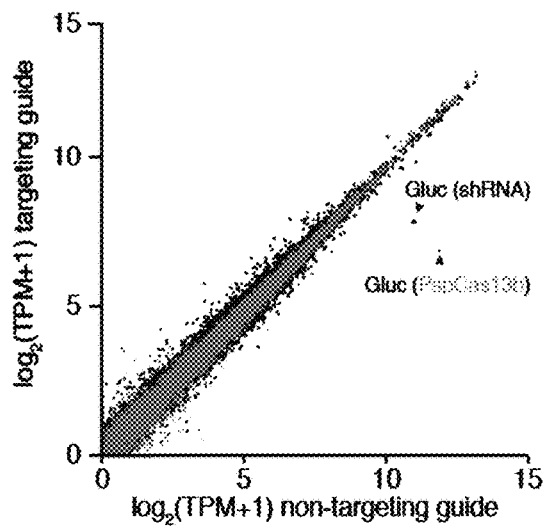
Figure 5G:
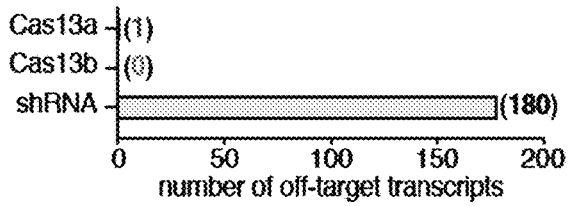

| Name | Spacer sequence | Interference Mechanism | Notes | First FIG. |
|---|---|---|---|---|
| shRNA-Gluc guide | CAGCTTTCCGGGCATTGGCTT (SEQ ID NO: 212) | shRNA | | FIG. 5F |
| Cas13b-Gluc guide-RNASeq | CCGCUGGAGGUGCUCAAAGA GAUGGAAGCC (SEQ ID NO: 213) | Cas13b | | FIG. 5F |
| Cas13a-Gluc-guide-1 | GCCAGCTTTCCGGGCATTGG CTTCCATC (SEQ ID NO: 214) | Cas13a | | FIG. 12A |
| Cas13a-Gluc-guide-2 | ACCCAGGAATCTCAGGAATG TCGACGAT (SEQ ID NO: 215) | Cas13a | | FIG. 12A |
| Cas13b-Gluc-opt-guide-1 | GGGCATTGGCTTCCATCTCTT TGAGCACCT (SEQ ID NO: 216) | Cas13b | | FIG. 12A |
| Cas13b-Gluc-opt-guide-2 | GAAUGUCGACGAUCGCCUCG CCUAUGCCGC (SEQ ID NO: 217) | Cas13b | | FIG. 12A |
| Cas13a KRAS guide 1 | CAAGGCACTCTTGCCTACGC CACCAGCT (SEQ ID NO: 218) | Cas13a | | FIG. 12B |
| Cas13a KRAS guide 2 | TCATATTCGTCCACAAAATG ATTCTGAA (SEQ ID NO: 219) | Cas13a | | FIG. 12B |
| Cas13a KRAS guide 3 | ATTATTTATGGCAAATACAC AAAGAAAG (SEQ ID NO: 220) | Cas13a | | FIG. 12B |
| Cas13a KRAS guide 4 | GAATATCTTCAAATGATTTAG TATTATT (SEQ ID NO: 221) | Cas13a | | FIG. 12B |
| Cas13a KRAS guide 5 | ACCATAGGTACATCTTCAGA GTCCTTAA (SEQ ID NO: 222) | Cas13a | | FIG. 12B |
| Cas13b KRAS guide 1 | GTCAAGGCACTCTTGCCTAC GCCACCAGCT (SEQ ID NO: 223) | Cas13b | | FIG. 12B |
| Cas13b KRAS guide 2 | GATCATATTCGTCCACAAAA TGATTCTGAA (SEQ ID NO: 224) | Cas13b | | FIG. 12B |
| Cas13b KRAS guide 3 | GTATTATTTATGGCAAATAC ACAAAGAAAG (SEQ ID NO: 225) | Cas13b | | FIG. 12B |
| Cas13b KRAS guide 4 | GTGAATATCTTCAAATGATT TAGTATTATT (SEQ ID NO: 226) | Cas13b | | FIG. 12B |
| Cas13b KRAS guide 5 | GGACCATAGGTACATCTTCA GAGTCCTTAA (SEQ ID NO: 227) | Cas13b | | FIG. 12B |
| shRNA KRAS guide 1 | aagagtgccttgacgataca gcCTCGAGgctgtatcgtca aggcactctt (SEQ ID NO: 228) | shRNA | | FIG. 12B |
| shRNA KRAS guide 2 | aatcattttgtggacgaata tCTCGAGatattcgtccaca aaatgatt (SEQ ID NO: 229) | shRNA | | FIG. 12B |

TABLE 9-continued

Guide/shRNA sequences used in this study for knockdown in mammalian cells

| Name | Spacer sequence | Interference Mechanism | Notes | First FIG. |
|---|---|---|---|---|
| shRNA KRAS guide 3 | aaataatactaaatcatttg aCTCGAGtcaaatgatttag tattattt (SEQ ID NO: 230) | shRNA | | FIG. 12B |
| shRNA KRAS guide 4 | aataatactaaatcatttga aCTCGAGttcaaatgattta gtattatt (SEQ ID NO: 231) | shRNA | | FIG. 12B |
| shRNA KRAS guide 5 | aaggactctgaagatgtacc tCTCGAGaggtacatcttca gagtcctt (SEQ ID NO: 232) | shRNA | | FIG. 12B |

TABLE 10

Guide sequences used for Gluc knockdown

| Name | Spacer sequence | Position | Notes | First FIG. |
|---|---|---|---|---|
| Gluc tiling guide 1 | GAGATCAGGGCAAACAG AACTTTGACTCCC (SEQ ID NO: 233) | 2 | Note that the Cas13a spacers are truncated by two nucleotides at the 5' end | 5C |
| Gluc tiling guide 2 | GGATGCAGATCAGGGCA AACAGAACTTTGA (SEQ ID NO: 234) | 7 | Note that the Cas13a spacers are truncated by two nucleotides at the 5' end | 5C |
| Gluc tiling guide 3 | GCACAGCGATGCAGATCA GGGCAAACAGAA (SEQ ID NO: 235) | 13 | Note that the Cas13a spacers are truncated by two nucleotides at the 5' end | 5C |
| Gluc tiling guide 4 | GCTCGGCCACAGCGATGC AGATCAGGGCAA (SEQ ID NO: 236) | 19 | Note that the Cas13a spacers are truncated by two nucleotides at the 5' end | 5C |
| Gluc tiling guide 5 | GGGGCTTGGCCTCGGCCA CAGCGATGCAGA (SEQ ID NO: 237) | 28 | Note that the Cas13a spacers are truncated by two nucleotides at the 5' end | 5C |
| Gluc tiling guide 6 | GTGGGCTTGGCCTCGGCC ACAGCGATGCAG (SEQ ID NO: 238 | 29 | Note that the Cas13a spacers are truncated by two nucleotides at the 5' end | 5C |
| Gluc tiling guide 7 | GTCTCGGTGGGCTTGGCC TCGGCCACAGCG (SEQ ID NO: 239) | 35 | Note that the Cas13a spacers are truncated by two nucleotides at the 5' end | 5C |
| Gluc tiling guide 8 | GTTCGTTGTTCTCGGTGG GCTTGGCCTCGG (SEQ ID NO: 240) | 43 | Note that the Cas13a spacers are truncated by two nucleotides at the 5' end | 5C |
| Gluc tiling guide 9 | GGAAGTCTTCGTTGTTCT CGGTGGGCTTGG (SEQ ID NO: 241) | 49 | Note that the Cas13a spacers are truncated by two nucleotides at the 5' end | 5C |
| Gluc tiling guide 10 | GATGTTGAAGTCTTCGTT GTTCTCGGTGGG (SEQ ID NO: 242) | 54 | Note that the Cas13a spacers are truncated by two nucleotides at the 5' end | 5C |
| Gluc tiling guide 11 | GCGGCCACGATGTTGAAG TCTTCGTTGTTC (SEQ ID NO: 243) | 62 | Note that the Cas13a spacers are truncated by two nucleotides at the 5' end | 5C |
| Gluc tiling guide 12 | GTGGCCACGGCCACGATG TTGAAGTCTTCG (SEQ ID NO: 244) | 68 | Note that the Cas13a spacers are truncated by two nucleotides at the 5' end | 5C |

TABLE 10-continued

Guide sequences used for Gluc knockdown

| Name | Spacer sequence | Position | Notes | First FIG. |
|---|---|---|---|---|
| Gluc tiling guide 13 | GGTTGCTGGCCACGGCCA CGATGTTGAAGT (SEQ ID NO: 245) | 73 | Note that the Cas13a spacers are truncated by two nucleotides at the 5' end | 5C |
| Gluc tiling guide 14 | GTCGCGAAGTTGCTGGCC ACGGCCACGATG (SEQ ID NO: 246) | 80 | Note that the Cas13a spacers are truncated by two nucleotides at the 5' end | 5C |
| Gluc tiling guide 15 | GCCGTGGTCGCGAAGTTG CTGGCCACGGCC (SEQ ID NO: 247) | 86 | Note that the Cas13a spacers are truncated by two nucleotides at the 5' end | 5C |
| Gluc tiling guide 16 | GCGAGATCCGTGGTCGCG AAGTTGCTGGCC (SEQ ID NO: 248) | 92 | Note that the Cas13a spacers are truncated by two nucleotides at the 5' end | 5C |
| Gluc tiling guide 17 | GCAGCATCGAGATCCGTG GTCGCGAAGTTG (SEQ ID NO: 249) | 98 | Note that the Cas13a spacers are truncated by two nucleotides at the 5' end | 5C |
| Gluc tiling guide 18 | GGGTCAGCATCGAGATCC GTGGTCGCGAAG (SEQ ID NO: 250) | 101 | Note that the Cas13a spacers are truncated by two nucleotides at the 5' end | 5C |
| Gluc tiling guide 19 | GCTTCCCGCGGTCAGCAT CGAGATCCGTGG (SEQ ID NO: 251) | 109 | Note that the Cas13a spacers are truncated by two nucleotides at the 5' end | 5C |
| Gluc tiling guide 20 | GGGGCAACTTCCCGCGGT CAGCATCGAGAT (SEQ ID NO: 252) | 115 | Note that the Cas13a spacers are truncated by two nucleotides at the 5' end | 5C |
| Gluc tiling guide 21 | GTCTTGCCGGGCAACTTC CCGCGGTCAGCA (SEQ ID NO: 253) | 122 | Note that the Cas13a spacers are truncated by two nucleotides at the 5' end | 5C |
| Gluc tiling guide 22 | GGCAGCTTCTTGCCGGGC AACTTCCCGCGG (SEQ ID NO: 254) | 128 | Note that the Cas13a spacers are truncated by two nucleotides at the 5' end | 5C |
| Gluc tiling guide 23 | GCCAGCGGCAGCTTCTTG CCGGGCAACTTC (SEQ ID NO: 255) | 134 | Note that the Cas13a spacers are truncated by two nucleotides at the 5' end | 5C |
| Gluc tiling guide 24 | GCACCTCCAGCGGCAGCT TCTTGCCGGGCA (SEQ ID NO: 256) | 139 | Note that the Cas13a spacers are truncated by two nucleotides at the 5' end | 5C |
| Gluc tiling guide 25 | GCTTTGAGCACCTCCAGC GGCAGCTTCTTG (SEQ ID NO: 257) | 146 | Note that the Cas13a spacers are truncated by two nucleotides at the 5' end | 5C |
| Gluc tiling guide 26 | GCATCTCTTTGAGCACCT CCAGCGGCAGCT (SEQ ID NO: 258) | 151 | Note that the Cas13a spacers are truncated by two nucleotides at the 5' end | 5C |
| Gluc tiling guide 27 | GTCCATCTCTTTGAGCAC CTCCAGCGGCAG (SEQ ID NO: 259) | 153 | Note that the Cas13a spacers are truncated by two nucleotides at the 5' end | 5C |
| Gluc tiling guide 28 | GGGCATTGGCTTCCATCT CTTTGAGCACCT (SEQ ID NO: 260) | 163 | Note that the Cas13a spacers are truncated by two nucleotides at the 5' end | 5C |
| Gluc tiling guide 29 | GTCCGGGCATTGGCTTCC ATCTCTTTGAGC (SEQ ID NO: 261) | 167 | Note that the Cas13a spacers are truncated by two nucleotides at the 5' end | 5C |
| Gluc tiling guide 30 | GGCCAGCTTTCCGGGCAT TGGCTTCCATCT (SEQ ID NO: 262) | 175 | Note that the Cas13a spacers are truncated by two nucleotides at the 5' end | 5C |
| Gluc tiling guide 31 | GGGTGCAGCCAGCTTTCC GGGCATTGGCTT (SEQ ID NO: 263) | 181 | Note that the Cas13a spacers are truncated by two nucleotides at the 5' end | 5C |

TABLE 10-continued

Guide sequences used for Gluc knockdown

| Name | Spacer sequence | Position | Notes | First FIG. |
|---|---|---|---|---|
| Gluc tiling guide 32 | GAGCCCCTGGTGCAGCCA GCTTTCCGGGCA (SEQ ID NO: 264) | 188 | Note that the Cas13a spacers are truncated by two nucleotides at the 5' end | 5C |
| Gluc tiling guide 33 | GATCAGACAGCCCCTGGT GCAGCCAGCTTT (SEQ ID NO: 265) | 195 | Note that the Cas13a spacers are truncated by two nucleotides at the 5' end | 5C |
| Gluc tiling guide 34 | GGCAGATCAGACAGCCCC TGGTGCAGCCAG (SEQ ID NO: 266) | 199 | Note that the Cas13a spacers are truncated by two nucleotides at the 5' end | 5C |
| Gluc tiling guide 35 | GACAGGCAGATCAGACA GCCCCTGGTGCAG (SEQ ID NO: 267) | 203 | Note that the Cas13a spacers are truncated by two nucleotides at the 5' end | 5C |
| Gluc tiling guide 36 | GTGATGTGGGACAGGCA GATCAGACAGCCC (SEQ ID NO: 268) | 212 | Note that the Cas13a spacers are truncated by two nucleotides at the 5' end | 5C |
| Gluc tiling guide 37 | GACTTGATGTGGGACAGG CAGATCAGACAG (SEQ ID NO: 269) | 215 | Note that the Cas13a spacers are truncated by two nucleotides at the 5' end | 5C |
| Gluc tiling guide 38 | GGGGCGTGCACTTGATGT GGGACAGGCAGA (SEQ ID NO: 270) | 223 | Note that the Cas13a spacers are truncated by two nucleotides at the 5' end | 5C |
| Gluc tiling guide 39 | GCTTCATCTTGGGCGTGC ACTTGATGTGGG (SEQ ID NO: 271) | 232 | Note that the Cas13a spacers are truncated by two nucleotides at the 5' end | 5C |
| Gluc tiling guide 40 | GTGAACTTCTTCATCTTG GGCGTGCACTTG (SEQ ID NO: 272) | 239 | Note that the Cas13a spacers are truncated by two nucleotides at the 5' end | 5C |
| Gluc tiling guide 41 | GGGATGAACTTCTTCATC TTGGGCGTGCAC (SEQ ID NO: 273) | 242 | Note that the Cas13a spacers are truncated by two nucleotides at the 5' end | 5C |
| Gluc tiling guide 42 | GTGGGATGAACTTCTTCA TCTTGGGCGTGC (SEQ ID NO: 274) | 244 | Note that the Cas13a spacers are truncated by two nucleotides at the 5' end | 5C |
| Gluc tiling guide 43 | GGGCAGCGTCCTGGGATG AACTTCTTCATC (SEQ ID NO: 275) | 254 | Note that the Cas13a spacers are truncated by two nucleotides at the 5' end | 5C |
| Gluc tiling guide 44 | GGGTGTGGCAGCGTCCTG GGATGAACTTCT (SEQ ID NO: 276) | 259 | Note that the Cas13a spacers are truncated by two nucleotides at the 5' end | 5C |
| Gluc tiling guide 45 | GTTCGTAGGTGTGGCAGC GTCCTGGGATGA (SEQ ID NO: 277) | 265 | Note that the Cas13a spacers are truncated by two nucleotides at the 5' end | 5C |
| Gluc tiling guide 46 | GCGCCTTCGTAGGTGTGG CAGCGTCCTGGG (SEQ ID NO: 278) | 269 | Note that the Cas13a spacers are truncated by two nucleotides at the 5' end | 5C |
| Gluc tiling guide 47 | GTCTTTGTCGCCTTCGTA GGTGTGGCAGCG (SEQ ID NO: 279) | 276 | Note that the Cas13a spacers are truncated by two nucleotides at the 5' end | 5C |
| Gluc tiling guide 48 | GCTTTGTCGCCTTCGTAG GTGTGGCAGCGT (SEQ ID NO: 280) | 275 | Note that the Cas13a spacers are truncated by two nucleotides at the 5' end | 5C |
| Gluc tiling guide 49 | GTGCCGCCCTGTGCGGAC TCTTTGTCGCCT (SEQ ID NO: 281) | 293 | Note that the Cas13a spacers are truncated by two nucleotides at the 5' end | 5C |

TABLE 10-continued

Guide sequences used for Gluc knockdown

| Name | Spacer sequence | Position | Notes | First FIG. |
|---|---|---|---|---|
| Gluc tiling guide 50 | GTATGCCGCCCTGTGCGG ACTCTTTGTCGC (SEQ ID NO: 282) | 295 | Note that the Cas13a spacers are truncated by two nucleotides at the 5' end | 5C |
| Gluc tiling guide 51 | GCCTCGCCTATGCCGCCC TGTGCGGACTCT (SEQ ID NO: 283) | 302 | Note that the Cas13a spacers are truncated by two nucleotides at the 5' end | 5C |
| Gluc tiling guide 52 | GGATCGCCTCGCCTATGC CGCCCTGTGCGG (SEQ ID NO: 284) | 307 | Note that the Cas13a spacers are truncated by two nucleotides at the 5' end | 5C |
| Gluc tiling guide 53 | GATGTCGACGATCGCCTC GCCTATGCCGCC (SEQ ID NO: 285) | 315 | Note that the Cas13a spacers are truncated by two nucleotides at the 5' end | 5C |
| Gluc tiling guide 54 | GCAGGAATGTCGACGATC GCCTCGCCTATG (SEQ ID NO: 286) | 320 | Note that the Cas13a spacers are truncated by two nucleotides at the 5' end | 5C |
| Gluc tiling guide 55 | GAATCTCAGGAATGTCGA CGATCGCCTCGC (SEQ ID NO: 287) | 325 | Note that the Cas13a spacers are truncated by two nucleotides at the 5' end | 5C |
| Gluc tiling guide 56 | GCCCAGGAATCTCAGGAA TGTCGACGATCG (SEQ ID NO: 288) | 331 | Note that the Cas13a spacers are truncated by two nucleotides at the 5' end | 5C |
| Gluc tiling guide 57 | GCCTTGAACCCAGGAATC TCAGGAATGTCG (SEQ ID NO: 289) | 338 | Note that the Cas13a spacers are truncated by two nucleotides at the 5' end | 5C |
| Gluc tiling guide 58 | GCCAAGTCCTTGAACCCA GGAATCTCAGGA (SEQ ID NO: 290) | 344 | Note that the Cas13a spacers are truncated by two nucleotides at the 5' end | 5C |
| Gluc tiling guide 59 | GTGGGCTCCAAGTCCTTG AACCCAGGAATC (SEQ ID NO: 291) | 350 | Note that the Cas13a spacers are truncated by two nucleotides at the 5' end | 5C |
| Gluc tiling guide 60 | GCCATGGGCTCCAAGTCC TTGAACCCAGGA (SEQ ID NO: 292) | 353 | Note that the Cas13a spacers are truncated by two nucleotides at the 5' end | 5C |
| Gluc tiling guide 61 | GGAACTGCTCCATGGGCT CCAAGTCCTTGA (SEQ ID NO: 293) | 361 | Note that the Cas13a spacers are truncated by two nucleotides at the 5' end | 5C |
| Gluc tiling guide 62 | GTGCGATGAACTGCTCCA TGGGCTCCAAGT (SEQ ID NO: 294) | 367 | Note that the Cas13a spacers are truncated by two nucleotides at the 5' end | 5C |
| Gluc tiling guide 63 | GGACCTGTGCGATGAACT GCTCCATGGGCT (SEQ ID NO: 295) | 373 | Note that the Cas13a spacers are truncated by two nucleotides at the 5' end | 5C |
| Gluc tiling guide 64 | GACAGATCGACCTGTGCG ATGAACTGCTCC (SEQ ID NO: 296) | 380 | Note that the Cas13a spacers are truncated by two nucleotides at the 5' end | 5C |
| Gluc tiling guide 65 | GACACACAGATCGACCTG TGCGATGAACTG (SEQ ID NO: 297) | 384 | Note that the Cas13a spacers are truncated by two nucleotides at the 5' end | 5C |
| Gluc tiling guide 66 | GTGCAGTCCACACACAGA TCGACCTGTGCG (SEQ ID NO: 298) | 392 | Note that the Cas13a spacers are truncated by two nucleotides at the 5' end | 5C |
| Gluc tiling guide 67 | GCCAGTTGTGCAGTCCAC ACACAGATCGAC (SEQ ID NO: 299) | 399 | Note that the Cas13a spacers are truncated by two nucleotides at the 5' end | 5C |
| Gluc tiling guide 68 | GGGCAGCCAGTTGTGCAG TCCACACACAGA (SEQ ID NO: 300) | 404 | Note that the Cas13a spacers are truncated by two nucleotides at the 5' end | 5C |

TABLE 10-continued

Guide sequences used for Gluc knockdown

| Name | Spacer sequence | Position | Notes | First FIG. |
|---|---|---|---|---|
| Gluc tiling guide 69 | GTTTGAGGCAGCCAGTTG TGCAGTCCACAC (SEQ ID NO: 301) | 409 | Note that the Cas13a spacers are truncated by two nucleotides at the 5' end | 5C |
| Gluc tiling guide 70 | GAAGCCCTTTGAGGCAGC CAGTTGTGCAGT (SEQ ID NO: 302) | 415 | Note that the Cas13a spacers are truncated by two nucleotides at the 5' end | 5C |
| Gluc tiling guide 71 | GCACGTTGGCAAGCCCTT TGAGGCAGCCAG (SEQ ID NO: 303) | 424 | Note that the Cas13a spacers are truncated by two nucleotides at the 5' end | 5C |
| Gluc tiling guide 72 | GACTGCACGTTGGCAAGC CCTTTGAGGCAG (SEQ ID NO: 304) | 428 | Note that the Cas13a spacers are truncated by two nucleotides at the 5' end | 5C |
| Gluc tiling guide 73 | GGGTCAGAACACTGCACG TTGGCAAGCCCT (SEQ ID NO: 305) | 437 | Note that the Cas13a spacers are truncated by two nucleotides at the 5' end | 5C |
| Gluc tiling guide 74 | GCAGGTCAGAACACTGCA CGTTGGCAAGCC (SEQ ID NO: 306) | 439 | Note that the Cas13a spacers are truncated by two nucleotides at the 5' end | 5C |
| Gluc tiling guide 75 | GAGCAGGTCAGAACACT GCACGTTGGCAAG (SEQ ID NO: 307) | 441 | Note that the Cas13a spacers are truncated by two nucleotides at the 5' end | 5C |
| Gluc tiling guide 76 | GGCCACTTCTTGAGCAGG TCAGAACACTGC (SEQ ID NO: 308) | 452 | Note that the Cas13a spacers are truncated by two nucleotides at the 5' end | 5C |
| Gluc tiling guide 77 | GCGGCAGCCACTTCTTGA GCAGGTCAGAAC (SEQ ID NO: 309) | 457 | Note that the Cas13a spacers are truncated by two nucleotides at the 5' end | 5C |
| Gluc tiling guide 78 | GTGCGGCAGCCACTTCTT GAGCAGGTCAGA (SEQ ID NO: 310) | 459 | Note that the Cas13a spacers are truncated by two nucleotides at the 5' end | 5C |
| Gluc tiling guide 79 | GAGCGTTGCGGCAGCCAC TTCTTGAGCAGG (SEQ ID NO: 311) | 464 | Note that the Cas13a spacers are truncated by two nucleotides at the 5' end | 5C |
| Gluc tiling guide 80 | GAAAGGTCGCACAGCGTT GCGGCAGCCACT (SEQ ID NO: 312) | 475 | Note that the Cas13a spacers are truncated by two nucleotides at the 5' end | 5C |
| Gluc tiling guide 81 | GCTGGCAAAGGTCGCACA GCGTTGCGGCAG (SEQ ID NO: 313) | 480 | Note that the Cas13a spacers are truncated by two nucleotides at the 5' end | 5C |
| Gluc tiling guide 82 | GGGCAAAGGTCGCACAG CGTTGCGGCAGCC (SEQ ID NO: 314) | 478 | Note that the Cas13a spacers are truncated by two nucleotides at the 5' end | 5C |
| Gluc tiling guide 83 | GTGGATCTTGCTGGCAAA GGTCGCACAGCG (SEQ ID NO: 315) | 489 | Note that the Cas13a spacers are truncated by two nucleotides at the 5' end | 5C |
| Gluc tiling guide 84 | GCACCTGGCCCTGGATCT TGCTGGCAAAGG (SEQ ID NO: 316) | 499 | Note that the Cas13a spacers are truncated by two nucleotides at the 5' end | 5C |
| Gluc tiling guide 85 | GTGGCCCTGGATCTTGCT GGCAAAGGTCGC (SEQ ID NO: 317) | 495 | Note that the Cas13a spacers are truncated by two nucleotides at the 5' end | 5C |
| Gluc tiling guide 86 | GTGATCTTGTCCACCTGG CCCTGGATCTTG (SEQ ID NO: 318) | 509 | Note that the Cas13a spacers are truncated by two nucleotides at the 5' end | 5C |

TABLE 10-continued

Guide sequences used for Gluc knockdown

| Name | Spacer sequence | Position | Notes | First FIG. |
|---|---|---|---|---|
| Gluc tiling guide 87 | GCCCCTTGATCTTGTCCA CCTGGCCCTGGA (SEQ ID NO: 319) | 514 | Note that the Cas13a spacers are truncated by two nucleotides at the 5' end | 5C |
| Gluc tiling guide 88 | GCCCTTGATCTTGTCCAC CTGGCCCTGGAT (SEQ ID NO: 320) | 513 | Note that the Cas13a spacers are truncated by two nucleotides at the 5' end | 5C |
| Gluc tiling guide 89 | GCCTTGATCTTGTCCACC TGGCCCTGGATC (SEQ ID NO: 321) | 512 | Note that the Cas13a spacers are truncated by two nucleotides at the 5' end | 5C |
| Gluc tiling guide 90 | GGCAAAGGTCGCACAGC GTTGCGGCAGCCA (SEQ ID NO: 322) | 477 | Note that the Cas13a spacers are truncated by two nucleotides at the 5' end | 5C |
| Gluc tiling guide 91 | GCAAAGGTCGCACAGCGT TGCGGCAGCCAC (SEQ ID NO: 323) | 476 | Note that the Cas13a spacers are truncated by two nucleotides at the 5' end | 5C |
| Gluc tiling guide 92 | GAAGGTCGCACAGCGTTG CGGCAGCCACTT (SEQ ID NO: 324) | 474 | Note that the Cas13a spacers are truncated by two nucleotides at the 5' end | 5C |
| Gluc tiling guide 93 | GAGGTCGCACAGCGTTGC GGCAGCCACTTC (SEQ ID NO: 325) | 473 | Note that the Cas13a spacers are truncated by two nucleotides at the 5' end | 5C |
| Non-targeting guide 1 | GGTAATGCCTGGCTTGTC GACGCATAGTCTG (SEQ ID NO: 326) | N/A | Note that the Cas13a spacers are truncated by two nucleotides at the 5' end | 5C |
| Non-targeting guide 2 | GGGAACCTTGGCCGTTAT AAAGTCTGACCAG (SEQ ID NO: 327) | N/A | Note that the Cas13a spacers are truncated by two nucleotides at the 5' end | 5C |
| Non-targeting guide 3 | GGAGGGTGAGAATTTAG AACCAAGATTGTTG (SEQ ID NO: 328) | N/A | Note that the Cas13a spacers are truncated by two nucleotides at the 5' end | 5C |

TABLE 11

Guide sequences used for Cluc knockdown

| Name | Spacer sequence | Position | Notes | First FIG. |
|---|---|---|---|---|
| Cluc tiling guide 1 | GAGTCCTGGCAATGAACA GTGGCGCAGTAG (SEQ ID NO: 329) | 32 | Note that the Cas13a spacers are truncated by two nucleotides at the 5' end | 5D |
| Cluc tiling guide 2 | GGGTGCCACAGCTGCTAT CAATACATTCTC (SEQ ID NO: 330) | 118 | Note that the Cas13a spacers are truncated by two nucleotides at the 5' end | 5D |
| Cluc tiling guide 3 | GTTACATACTGACACATT CGGCAACATGTT (SEQ ID NO: 331) | 197 | Note that the Cas13a spacers are truncated by two nucleotides at the 5' end | 5D |
| Cluc tiling guide 4 | GTATGTACCAGGTTCCTG GAACTGGAATCT (SEQ ID NO: 332) | 276 | Note that the Cas13a spacers are truncated by two nucleotides at the 5' end | 5D |
| Cluc tiling guide 5 | GCCTTGGTTCCATCCAGG TTCTCCAGGGTG (SEQ ID NO: 333) | 350 | Note that the Cas13a spacers are truncated by two nucleotides at the 5' end | 5D |
| Cluc tiling guide 6 | GCAGTGATGGGATTCTCA GTAGCTTGAGCG (SEQ ID NO: 334) | 431 | Note that the Cas13a spacers are truncated by two nucleotides at the 5' end | 5D |

TABLE 11-continued

Guide sequences used for Cluc knockdown

| Name | Spacer sequence | Position | Notes | First FIG. |
|---|---|---|---|---|
| Cluc tiling guide 7 | GAGCCTGGCATCTCAACA ACAGCGATGGTG (SEQ ID NO: 335) | 512 | Note that the Cas13a spacers are truncated by two nucleotides at the 5' end | 5D |
| Cluc tiling guide 8 | GTGTCTGGGGCGATTCTT ACAGATCTTCCT (SEQ ID NO: 336) | 593 | Note that the Cas13a spacers are truncated by two nucleotides at the 5' end | 5D |
| Cluc tiling guide 9 | GCTGGATCTGAAGTGAAG TCTGTATCTTCC (SEQ ID NO: 337) | 671 | Note that the Cas13a spacers are truncated by two nucleotides at the 5' end | 5D |
| Cluc tiling guide 10 | GGCAACGTCATCAGGATT TCCATAGAGTGG (SEQ ID NO: 338) | 747 | Note that the Cas13a spacers are truncated by two nucleotides at the 5' end | 5D |
| Cluc tiling guide 11 | GAGGCGCAGGAGATGGT GTAGTAGTAGAAG (SEQ ID NO: 339) | 830 | Note that the Cas13a spacers are truncated by two nucleotides at the 5' end | 5D |
| Cluc tiling guide 13 | GAGGGACCCTGGAATTGG TATCTTGCTTTG (SEQ ID NO: 340) | 986 | Note that the Cas13a spacers are truncated by two nucleotides at the 5' end | 5D |
| Cluc tiling guide 14 | GGTAAGAGTCAACATTCC TGTGTGAAACCT (SEQ ID NO: 341) | 1066 | Note that the Cas13a spacers are truncated by two nucleotides at the 5' end | 5D |
| Cluc tiling guide 15 | GACCAGAATCTGTTTTCC ATCAACAATGAG (SEQ ID NO: 342) | 1143 | Note that the Cas13a spacers are truncated by two nucleotides at the 5' end | 5D |
| Cluc tiling guide 16 | GATGGCTGTAGTCAGTAT GTCACCATCTTG (SEQ ID NO: 343) | 1227 | Note that the Cas13a spacers are truncated by two nucleotides at the 5' end | 5D |
| Cluc tiling guide 17 | GTACCATCGAATGGATCT CTAATATGTACG (SEQ ID NO: 344) | 1304 | Note that the Cas13a spacers are truncated by two nucleotides at the 5' end | 5D |
| Cluc tiling guide 18 | GAGATCACAGGCTCCTTC AGCATCAAAAGA (SEQ ID NO: 345) | 1380 | Note that the Cas13a spacers are truncated by two nucleotides at the 5' end | 5D |
| Cluc tiling guide 19 | GCTTTGACCGGCGAAGAG ACTATTGCAGAG (SEQ ID NO: 346) | 1461 | Note that the Cas13a spacers are truncated by two nucleotides at the 5' end | 5D |
| Cluc tiling guide 20 | GCCCCTCAGGCAATACTC GTACATGCATCG (SEQ ID NO: 347) | 1539 | Note that the Cas13a spacers are truncated by two nucleotides at the 5' end | 5D |
| Cluc tiling guide 21 | GCTGGTACTTCTAGGGTG TCTCCATGCTTT (SEQ ID NO: 348) | 1619 | Note that the Cas13a spacers are truncated by two nucleotides at the 5' end | 5D |
| Non-targeting guide 1 | GGTAATGCCTGGCTTGTC GACGCATAGTCTG (SEQ ID NO: 349) | N/A | Note that the Cas13a spacers are truncated by two nucleotides at the 5' end | 5D |
| Non-targeting guide 2 | GGGAACCTTGGCCGTTAT AAAGTCTGACCAG (SEQ ID NO: 350) | N/A | Note that the Cas13a spacers are truncated by two nucleotides at the 5' end | 5D |
| Non-targeting guide 3 | GGAGGGTGAGAATTTAG AACCAAGATTGTTG (SEQ ID NO: 351) | N/A | Note that the Cas13a spacers are truncated by two nucleotides at the 5' end | 5D |

TABLE 12

Guide sequences used in this study for RNA editing in mammalian cells. Mismatched base flips are capitalized

| Name | Spacer sequence | Notes | First FIG. |
|---|---|---|---|
| Tiling 30 nt 30 mismatch distance | gCatcctgcggcctctactctgcattcaatt (SEQ ID NO: 352) | Has a 5' G for U6 expression | 6C |
| Tiling 30 nt 28 mismatch distance | gacCatcctgcggcctctactctgcattcaa (SEQ ID NO: 353) | Has a 5' G for U6 expression | 6C |
| Tiling 30 nt 26 mismatch distance | gaaacCatcctgcggcctctactctgcattc (SEQ ID NO: 354) | Has a 5' G for U6 expression | 6C |
| Tiling 30 nt 24 mismatch distance | gctaaacCatcctgcggcctctactctgcat (SEQ ID NO: 355) | Has a 5' G for U6 expression | 6C |
| Tiling 30 nt 22 mismatch distance | gttctaaacCatcctgcggcctctactctgc (SEQ ID NO: 356) | Has a 5' G for U6 expression | 6C |
| Tiling 30 nt 20 mismatch distance | gtgttctaaacCatcctgcggcctctactct (SEQ ID NO: 357) | Has a 5' G for U6 expression | 6C |
| Tiling 30 nt 18 mismatch distance | gaatgttctaaacCatcctgcggcctctact (SEQ ID NO: 358) | Has a 5' G for U6 expression | 6C |
| Tiling 30 nt 16 mismatch distance | gagaatgttctaaacCatcctgcggcctcta (SEQ ID NO: 359) | Has a 5' G for U6 expression | 6C |
| Tiling 30 nt 14 mismatch distance | gatagaatgttctaaacCatcctgcggcctc (SEQ ID NO: 360) | Has a 5' G for U6 expression | 6C |
| Tiling 30 nt 12 mismatch distance | gccatagaatgttctaaacCatcctgcggcc (SEQ ID NO: 361) | Has a 5' G for U6 expression | 6C |
| Tiling 30 nt 10 mismatch distance | gttccatagaatgttctaaacCatcctgcgg (SEQ ID NO: 362) | Has a 5' G for U6 expression | 6C |
| Tiling 30 nt 8 mismatch distance | gctaccatagaatgttctaaacCatcctgc (SEQ ID NO: 363) | Has a 5' G for U6 expression | 6C |
| Tiling 30 nt 6 mismatch distance | gctctaccatagaatgttctaaacCatcct (SEQ ID NO: 364) | Has a 5' G for U6 expression | 6C |
| Tiling 30 nt 4 mismatch distance | gatctctaccatagaatgttctaaacCatc (SEQ ID NO: 365) | Has a 5' G for U6 expression | 6C |
| Tiling 30 nt 2 mismatch distance | ggaatctctaccatagaatgttctaaacCa (SEQ ID NO: 366) | Has a 5' G for U6 expression | 6C |
| Tiling 50 nt 50 mismatch distance | gCatcctgcggcctctactctgcattcaattacatactgacacattcggca (SEQ ID NO: 367) | Has a 5' G for U6 expression | 6C |
| Tiling 50 nt 48 mismatch distance | gacCatcctgcggcctctactctgcattcaattacatactgacacattcgg (SEQ ID NO: 368) | Has a 5' G for U6 expression | 6C |
| Tiling 50 nt 46 mismatch distance | gaaacCatcctgcggcctctactctgcattcaattacatactgacacattc (SEQ ID NO: 369) | Has a 5' G for U6 expression | 6C |
| Tiling 50 nt 44 mismatch distance | gctaaacCatcctgcggcctctactctgcattcaattacatactgacacat (SEQ ID NO: 370) | Has a 5' G for U6 expression | 6C |
| Tiling 50 nt 42 mismatch distance | gttctaaacCatcctgcggcctctactctgcattcaattacatactgacac (SEQ ID NO: 371) | Has a 5' G for U6 expression | 6C |
| Tiling 50 nt 40 mismatch distance | gtgttctaaacCatcctgcggcctctactctgcattcaattacatactgac (SEQ ID NO: 372) | Has a 5' G for U6 expression | 6C |
| Tiling 50 nt 38 mismatch distance | gaatgttctaaacCatcctgcggcctctactctgcattcaattacatactg (SEQ ID NO: 373) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
|---|---|---|---|
| Tiling 50 nt 36 mismatch distance | gagaatgttctaaacCatcctgcggcctcta ctctgcattcaattacatac(SEQ ID NO: 374) | Has a 5' G for U6 expression | 6C |
| Tiling 50 nt 34 mismatch distance | gatagaatgttctaaacCatcctgcggcctc tactctgcattcaattacat(SEQ ID NO: 375) | Has a 5' G for U6 expression | 6C |
| Tiling 50 nt 32 mismatch distance | gccatagaatgttctaaacCatcctgcggcc tctactctgcattcaattac(SEQ ID NO: 376) | Has a 5' G for U6 expression | 6C |
| Tiling 50 nt 30 mismatch distance | gttccatagaatgttctaaacCatcctgcgg cctctactctgcattcaatt(SEQ ID NO: 377) | Has a 5' G for U6 expression | 6C |
| Tiling 50 nt 28 mismatch distance | gctaccatagaatgttctaaacCatcctgcg gcctctactctgcattcaa(SEQ ID NO: 378) | Has a 5' G for U6 expression | 6C |
| Tiling 50 nt 26 mismatch distance | gctctaccatagaatgttctaaacCatcctg cggcctctactctgcattc(SEQ ID NO: 379) | Has a 5' G for U6 expression | 6C |
| Tiling 50 nt 24 mismatch distance | gatctctaccatagaatgttctaaacCatcc tgcggcctctactctgcat(SEQ ID NO: 380) | Has a 5' G for U6 expression | 6C |
| Tiling 50 nt 22 mismatch distance | ggaatctctaccatagaatgttctaaacCat cctgcggcctctactctgc(SEQ ID NO: 381) | Has a 5' G for U6 expression | 6C |
| Tiling 50 nt 20 mismatch distance | gtggaatctctaccatagaatgttctaaacC atcctgcggcctctactct(SEQ ID NO: 382) | Has a 5' G for U6 expression | 6C |
| Tiling 50 nt 18 mismatch distance | gactggaatctctaccatagaatgttctaaa cCatcctgcggcctctact(SEQ ID NO: 383) | Has a 5' G for U6 expression | 6C |
| Tiling 50 nt 16 mismatch distance | ggaactggaatctctaccatagaatgttcta aacCatcctgcggcctcta(SEQ ID NO: 384) | Has a 5' G for U6 expression | 6C |
| Tiling 50 nt 14 mismatch distance | gtggaactggaatctctttccatagaatgtt ctaaacCatcctgcggcctc(SEQ ID NO; 385) | Has a 5' G for U6 expression | 6C |
| Tiling 50 nt 12 mismatch distance | gcctggaactggaatctctttccatagaatg ttctaaacCatcctgcggcc(SEQ ID NO: 386) | Has a 5' G for U6 expression | 6C |
| Tiling 50 nt 10 mismatch distance | gttcctggaactggaatctctaccatagaat gttctaaacCatcctgcgg(SEQ ID NO: 387) | Has a 5' G for U6 expression | 6C |
| Tiling 50 nt 8 mismatch distance | gggttcctggaactggaatctctttccatag aatgttctaaacCatcctgc(SEQ ID NO: 388) | Has a 5' G for U6 expression | 6C |
| Tiling 50 nt 6 mismatch distance | gcaggttcctggaactggaatctctttccat agaatgttctaaacCatcct(SEQ ID NO; 389) | Has a 5' G for U6 expression | 6C |
| Tiling 50 nt 4 mismatch distance | gaccaggttcctggaactggaatctctacca tagaatgttctaaacCatc(SEQ ID NO: 390) | Has a 5' G for U6 expression | 6C |
| Tiling 50 nt 2 mismatch distance | ggtaccaggttcctggaactggaatctcttt ccatagaatgttctaaacCa(SEQ ID NO: 391) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
|---|---|---|---|
| Tiling 70 nt 70 mismatch distance | gCatcctgcggcctctactctgcattcaattacatactgacacattcggcaacatgttttctctggtttat(SEQ ID NO: 392) | Has a 5' G for U6 expression | 6C |
| Tiling 70 nt 68 mismatch distance | gacCatcctgcggcctctactctgcattcaattacatactgacacattcggcaacatgtttttcctggttt(SEQ ID NO: 393) | Has a 5' G for U6 expression | 6C |
| Tiling 70 nt 66 mismatch distance | gaaacCatcctgcggcctctactctgcattcaattacatactgacacattcggcaacatgttttcctggt(SEQ ID NO: 394) | Has a 5' G for U6 expression | 6C |
| Tiling 70 nt 64 mismatch distance | gctaaacCatcctgcggcctctactctgcattcaattacatactgacacattcggcaacatgttttcctg(SEQ ID NO: 395) | Has a 5' G for U6 expression | 6C |
| Tiling 70 nt 62 mismatch distance | gttctaaacCatcctgcggcctctactctgcattcaattacatactgacacattcggcaacatgttttcc(SEQ ID NO: 396) | Has a 5' G for U6 expression | 6C |
| Tiling 70 nt 60 mismatch distance | gtgttctaaacCatcctgcggcctctactctgcattcaattacatactgacacattcggcaacatgttttt(SEQ ID NO: 397) | Has a 5' G for U6 expression | 6C |
| Tiling 70 nt 58 mismatch distance | gaatgttctaaacCatcctgcggcctctactctgcattcaattacatactgacacattcggcaacatgttt(SEQ ID NO: 398) | Has a 5' G for U6 expression | 6C |
| Tiling 70 nt 56 mismatch distance | gagaatgttctaaacCatcctgcggcctctactctgcattcaattacatactgacacattcggcaacatgt(SEQ ID NO: 399) | Has a 5' G for U6 expression | 6C |
| Tiling 70 nt 54 mismatch distance | gatagaatgttctaaacCatcctgcggcctctactctgcattcaattacatactgacacattcggcaacat(SEQ ID NO: 400) | Has a 5' G for U6 expression | 6C |
| Tiling 70 nt 52 mismatch distance | gccatagaatgttctaaacCatcctgcggcctctactctgcattcaattacatactgacacattcggcaac(SEQ ID NO: 401) | Has a 5' G for U6 expression | 6C |
| Tiling 70 nt 50 mismatch distance | gttccatagaatgttctaaacCatcctgcggcctctactctgcattcaattacatactgacacattcggca(SEQ ID NO: 402) | Has a 5' G for U6 expression | 6C |
| Tiling 70 nt 48 mismatch distance | gctaccatagaatgttctaaacCatcctgcggcctctactctgcattcaattacatactgacacattcgg(SEQ ID NO: 403) | Has a 5' G for U6 expression | 6C |
| Tiling 70 nt 46 mismatch distance | gctctaccatagaatgttctaaacCatcctgcggcctctactctgcattcaattacatactgacacattc(SEQ ID NO: 404) | Has a 5' G for U6 expression | 6C |
| Tiling 70 nt 44 mismatch distance | gatctctaccatagaatgttctaaacCatcctgcggcctctactctgcattcaattacatactgacacat(SEQ ID NO: 405) | Has a 5' G for U6 expression | 6C |
| Tiling 70 nt 42 mismatch distance | ggaatctctaccatagaatgttctaaacCatcctgcggcctctactctgcattcaattacatactgacac(SEQ ID NO: 406) | Has a 5' G for U6 expression | 6C |
| Tiling 70 nt 40 mismatch distance | gtggaatctctaccatagaatgttctaaacCatcctgcggcctctactctgcattcaattacatactgac(SEQ ID NO: 407) | Has a 5' G for U6 expression | 6C |
| Tiling 70 nt 38 mismatch distance | gactggaatctctaccatagaatgttctaaacCatcctgcggcctctactctgcattcaattacatactg(SEQ ID NO: 408) | Has a 5' G for U6 expression | 6C |
| Tiling 70 nt 36 mismatch distance | ggaactggaatctctaccatagaatgttctaaacCatcctgcggcctctactctgcattcaattacatac(SEQ ID NO: 409) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
|---|---|---|---|
| Tiling 70 nt 34 mismatch distance | gtggaactggaatctctttccatagaatgtt ctaaacCatcctgcggcctctactctgcatt caattacat(SEQ ID NO: 410) | Has a 5' G for U6 expression | 6C |
| Tiling 70 nt 32 mismatch distance | gcctggaactggaatctctttccatagaatg ttctaaacCatcctgcggcctctactctgca ttcaattac(SEQ ID NO: 411) | Has a 5' G for U6 expression | 6C |
| Tiling 70 nt 30 mismatch distance | gttcctggaactggaatctattccatagaat gttctaaacCatcctgcggcctctactctgc attcaaft(SEQ ID NO: 412) | Has a 5' G for U6 expression | 6C |
| Tiling 70 nt 28 mismatch distance | gggttcctggaactggaatctctttccatag aatgttctaaacCatcctgcggcctctactc tgcattcaa(SEQ ID NO: 413) | Has a 5' G for U6 expression | 6C |
| Tiling 70 nt 26 mismatch distance | gcaggttcctggaactggaatctctttccat agaatgttctaaacCatcctgcggcctctac tctgcattc(SEQ ID NO: 414) | Has a 5' G for U6 expression | 6C |
| Tiling 70 nt 24 mismatch distance | gaccaggttcctggaactggaatctctttcc atagaatgttctaaacCatcctgcggcctct actctgcat(SEQ ID NO: 415) | Has a 5' G for U6 expression | 6C |
| Tiling 70 nt 22 mismatch distance | ggtaccaggttcctggaactggaatctcttt ccatagaatgttctaaacCatcctgcggcct ctactctgc(SEQ ID NO: 416) | Has a 5' G for U6 expression | 6C |
| Tiling 70 nt 20 mismatch distance | gatgtaccaggttcctggaactggaatctat tccatagaatgttctaaacCatcctgcggcc tctactct(SEQ ID NO: 417) | Has a 5' G for U6 expression | 6C |
| Tiling 70 nt 18 mismatch distance | ggtatgtaccaggttcctggaactggaatct ctttccatagaatgttctaaacCatcctgcg gcctctact(SEQ ID NO: 418) | Has a 5' G for U6 expression | 6C |
| Tiling 70 nt 16 mismatch distance | gacgtatgtaccaggttcctggaactggaat ctctttccatagaatgttctaaacCatcctg cggcctcta(SEQ ID NO: 419) | Has a 5' G for U6 expression | 6C |
| Tiling 70 nt 14 mismatch distance | gacacgtatgtaccaggttcctggaactgga atctattccatagaatgttctaaacCatcct gcggcctc(SEQ ID NO: 420) | Has a 5' G for U6 expression | 6C |
| Tiling 70 nt 12 mismatch distance | gcaacacgtatgtaccaggttcctggaactg gaatctctttccatagaatgttctaaacCat cctgcggcc(SEQ ID NO: 421) | Has a 5' G for U6 expression | 6C |
| Tiling 70 nt 10 mismatch distance | gcccaacacgtatgtaccaggttcctggaac tggaatctctttccatagaatgttctaaacC atcctgcgg(SEQ ID NO: 422) | Has a 5' G for U6 expression | 6C |
| Tiling 70 nt 8 mismatch distance | ggacccaacacgtatgtaccaggttcctgga actggaatctctttccatagaatgttctaaa cCatcctgc(SEQ ID NO: 423) | Has a 5' G for U6 expression | 6C |
| Tiling 70 nt 6 mismatch distance | gttgacccaacacgtatgtaccaggttcctg gaactggaatctctttccatagaatgttcta aacCatcct(SEQ ID NO: 424) | Has a 5' G for U6 expression | 6C |
| Tiling 70 nt 4 mismatch distance | gccttgacccaacacgtatgtaccaggttcc tggaactggaatctctttccatagaatgttc taaacCatc(SEQ ID NO: 425) | Has a 5' G for U6 expression | 6C |
| Tiling 70 nt 2 mismatch distance | gttccttgacccaacacgtatgtaccaggtt cctggaactggaatctctttccatagaatgt tctaaacCa(SEQ ID NO: 426) | Has a 5' G for U6 expression | 6C |
| Tiling 84 nt 84 mismatch distance | gCatcctgcggcctctactctgcattcaatt acatactgacacattcggcaacatgttttc ctggtttattttcacacagtcca(SEQ ID NO: 427) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
|---|---|---|---|
| Tiling 84 nt 82 mismatch distance | gacCatcctgcggcctctactctgcattcaa ttacatactgacacattcggcaacatgtttt tcctggtttattttcacacagtc (SEQ ID NO: 428) | Has a 5' G for U6 expression | 6C |
| Tiling 84 nt 80 mismatch distance | gaaacCatcctgcggcctctactctgcattc aattacatactgacacattcggcaacatgcc tggtttattttcacacag (SEQ ID NO: 429) | Has a 5' G for U6 expression | 6C |
| Tiling 84 nt 78 mismatch distance | gctaaacCatcctgcggcctctactctgcat tcaattacatactgacacattcggcaacatg tttttcctggtttattttcacac (SEQ ID NO: 430) | Has a 5' G for U6 expression | 6C |
| Tiling 84 nt 76 mismatch distance | gttctaaacCatcctgcggcctctactctgc attcaattacatactgacacattcggcaaca tgttttcctggtttattttcac (SEQ ID NO: 431) | Has a 5' G for U6 expression | 6C |
| Tiling 84 nt 74 mismatch distance | gtgttctaaacCatcctgcggcctctactct gcattcaattacatactgacacattcggcaa catgttttcctggtttattttc (SEQ ID NO: 432) | Has a 5' G for U6 expression | 6C |
| Tiling 84 nt 72 mismatch distance | gaatgttctaaacCatcctgcggcctctact ctgcattcaattacatactgacacattcggc aacatgttttcctggtttattt (SEQ ID NO: 433) | Has a 5' G for U6 expression | 6C |
| Tiling 84 nt 70 mismatch distance | gagaatgttctaaacCatcctgcggcctcta ctctgcattcaattacatactgacacattcg gcaacatgttttcctggtttat (SEQ ID NO: 434) | Has a 5' G for U6 expression | 6C |
| Tiling 84 nt 68 mismatch distance | gatagaatgttctaaacCatcctgcggcctc tactctgcattcaattacatactgacacatt cggcaacatgttttcctggttt (SEQ ID NO: 435) | Has a 5' G for U6 expression | 6C |
| Tiling 84 nt 66 mismatch distance | gccatagaatgttctaaacCatcctgcggcc tctactctgcattcaattacatactgacaca ttcggcaacatgttttcctggt (SEQ ID NO: 436) | Has a 5' G for U6 expression | 6C |
| Tiling 84 nt 64 mismatch distance | gttccatagaatgttctaaacCatcctgcgg cctctactctgcattcaattacatactgaca cattcggcaacatgttttcctg (SEQ ID NO: 437) | Has a 5' G for U6 expression | 6C |
| Tiling 84 nt 62 mismatch distance | gctttccatagaatgttctaaacCatcctgc ggcctctactctgcattcaattacatactga cacattcggcaacatgttttcc (SEQ ID NO: 438) | Has a 5' G for U6 expression | 6C |
| Tiling 84 nt 60 mismatch distance | gctctttccatagaatgttctaaacCatcct gcggcctctactctgcattcaattacatact gacacattcggcaacatgttttt (SEQ ID NO: 439) | Has a 5' G for U6 expression | 6C |
| Tiling 84 nt 58 mismatch distance | gatctctttccatagaatgttctaaacCatc ctgcggcctctactctgcattcaattacata ctgacacattcggcaacatgttt (SEQ ID NO: 440) | Has a 5' G for U6 expression | 6C |
| Tiling 84 nt 56 mismatch distance | ggaatctattccatagaatgttctaaacCat cctgcggcctctactctgcattcaattacat actgacacattcggcaacatgt (SEQ ID NO: 441) | Has a 5' G for U6 expression | 6C |
| Tiling 84 nt 54 mismatch distance | gtggaatctctttccatagaatgttctaaac Catcctgcggcctctactctgcattcaatta catactgacacattcggcaacat (SEQ ID NO: 442) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
| --- | --- | --- | --- |
| Tiling 84 nt 52 mismatch distance | gactggaatctctaccatagaatgttctaaa cCatcctgcggcctctactctgcattcaatt acatactgacacattcggcaac(SEQ ID NO: 443) | Has a 5' G for U6 expression | 6C |
| Tiling 84 nt 50 mismatch distance | ggaactggaatctctaccatagaatgttcta aacCatcctgcggcctctactctgcattcaa ttacatactgacacattcggca(SEQ ID NO: 444) | Has a 5' G for U6 expression | 6C |
| Tiling 84 nt 48 mismatch distance | gtggaactggaatctctttccatagaatgtt ctaaacCatcctgcggcctctactctgcatt caattacatactgacacattcgg(SEQ ID NO: 445) | Has a 5' G for U6 expression | 6C |
| Tiling 84 nt 46 mismatch distance | gcctggaactggaatctctttccatagaatg ttctaaacCatcctgcggcctctactctgca ttcaattacatactgacacattc(SEQ ID NO: 446) | Has a 5' G for U6 expression | 6C |
| Tiling 84 nt 44 mismatch distance | gttcctggaactggaatctctaccatagaat gttctaaacCatcctgcggcctctactctgc attcaattacatactgacacat(SEQ ID NO: 447) | Has a 5' G for U6 expression | 6C |
| Tiling 84 nt 42 mismatch distance | gggttcctggaactggaatctctttccatag aatgttctaaacCatcctgcggcctctactc tgcattcaattacatactgacac(SEQ ID NO: 448) | Has a 5' G for U6 expression | 6C |
| Tiling 84 nt 40 mismatch distance | gcaggttcctggaactggaatctctttccat agaatgttctaaacCatcctgcggcctctac tctgcattcaattacatactgac(SEQ ID NO: 449) | Has a 5' G for U6 expression | 6C |
| Tiling 84 nt 38 mismatch distance | gaccaggttcctggaactggaatctctacca tagaatgttctaaacCatcctgcggcctcta ctctgcattcaattacatactg(SEQ ID NO: 450) | Has a 5' G for U6 expression | 6C |
| Tiling 84 nt 36 mismatch distance | ggtaccaggttcctggaactggaatctcttt ccatagaatgttctaaacCatcctgcggcct ctactctgcattcaattacatac(SEQ ID NO: 451) | Has a 5' G for U6 expression | 6C |
| Tiling 84 nt 34 mismatch distance | gatgtaccaggttcctggaactggaatctct accatagaatgttctaaacCatcctgcggcc tctactctgcattcaattacat(SEQ ID NO: 452) | Has a 5' G for U6 expression | 6C |
| Tiling 84 nt 32 mismatch distance | ggtatgtaccaggttcctggaactggaatct ctttccatagaatgttctaaacCatcctgcg gcctctactctgcattcaattac(SEQ ID NO: 453) | Has a 5' G for U6 expression | 6C |
| Tiling 84 nt 30 mismatch distance | gacgtatgtaccaggttcctggaactggaat ctctaccatagaatgttctaaacCatcctgc ggcctctactctgcattcaatt(SEQ ID NO: 454) | Has a 5' G for U6 expression | 6C |
| Tiling 84 nt 28 mismatch distance | gacacgtatgtaccaggttcctggaactgga atctctaccatagaatgttctaaacCatcct gcggcctctactctgcattcaa(SEQ ID NO: 455) | Has a 5' G for U6 expression | 6C |
| Tiling 84 nt 26 mismatch distance | gcaacacgtatgtaccaggttcctggaactg gaatctctttccatagaatgttctaaacCat cctgcggcctctactctgcattc(SEQ ID NO: 456) | Has a 5' G for U6 expression | 6C |

TABLE 12-continued

Guide sequences used in this study for RNA editing in mammalian cells.
Mismatched base flips are capitalized

| Name | Spacer sequence | Notes | First FIG. |
|---|---|---|---|
| Tiling 84 nt 24 mismatch distance | gcccaacacgtatgtaccaggttcctggaac tggaatctattccatagaatgttctaaacCa tcctgcggcctctactctgcat(SEQ ID NO: 457) | Has a 5' G for U6 expression | 6C |
| Tiling 84 nt 22 mismatch distance | ggacccaacacgtatgtaccaggttcctgga actggaatctctttccatagaatgttctaaa cCatcctgcggcctctactctgc(SEQ ID NO: 458) | Has a 5' G for U6 expression | 6C |
| Tiling 84 nt 20 mismatch distance | gttgacccaacacgtatgtaccaggttcctg gaactggaatctctttccatagaatgttcta aacCatcctgcggcctctactct(SEQ ID NO: 459) | Has a 5' G for U6 expression | 6C |
| Tiling 84 nt 18 mismatch distance | gccttgacccaacacgtatgtaccaggttcc tggaactggaatctctttccatagaatgttc taaacCatcctgcggcctctact(SEQ ID NO: 460) | Has a 5' G for U6 expression | 6C |
| Tiling 84 nt 16 mismatch distance | gttccttgacccaacacgtatgtaccaggtt cctggaactggaatctctttccatagaatgt tctaaacCatcctgcggcctcta(SEQ ID NO: 545) | Has a 5' G for U6 expression | 6C |
| Tiling 84 nt 14 mismatch distance | gggttccttgacccaacacgtatgtaccagg ttcctggaactggaatctctttccatagaat gttctaaacCatcctgcggcctc(SEQ ID NO: 461) | Has a 5' G for U6 expression | 6C |
| Tiling 84 nt 12 mismatch distance | gttggttccttgacccaacacgtatgtacca ggttcctggaactggaatctctttccataga atgttctaaacCatcctgcggcc(SEQ ID NO: 462) | Has a 5' G for U6 expression | 6C |
| Tiling 84 nt 10 mismatch distance | gccttggttccttgacccaacacgtatgtac caggttcctggaactggaatctattccatag aatgttctaaacCatcctgcgg(SEQ ID NO: 463) | Has a 5' G for U6 expression | 6C |
| Tiling 84 nt 8 mismatch distance | ggcccttggttccttgacccaacacgtatgt accaggttcctggaactggaatctattccat agaatgttctaaacCatcctgc(SEQ ID NO: 464) | Has a 5' G for U6 expression | 6C |
| Tiling 84 nt 6 mismatch distance | gccgccatggttccttgacccaacacgtatg taccaggttcctggaactggaatctctttcc atagaatgttctaaacCatcct(SEQ ID NO: 465) | Has a 5' G for U6 expression | 6C |
| Tiling 84 nt 4 mismatch distance | gcgccgcccttggttccttgacccaacacgt atgtaccaggttcctggaactggaatctctt tccatagaatgttctaaacCatc(SEQ ID NO: 466) | Has a 5' G for U6 expression | 6C |
| Tiling 84 nt 2 mismatch distance | ggtcgccgcccttggttccttgacccaacac gtatgtaccaggttcctggaactggaatctc atttcctagaatgttctaaacCa(SEQ ID NO: 467) | Has a 5' G for U6 expression | 6C |
| ADAR non-targeting guide | GTAATGCCTGGCTTGTCGACGCATAGTCTG (SEQ ID NO: 468) | Has a 5' G for U6 expression | 6C |
| PFS binding screen guide for TAG motif | gaaaacgcaggttcctcCagtttcgggagca gcgcacgtctccctgtagtc(SEQ ID NO: 469) | Has a 5' G for U6 expression | 7B |
| PFS binding screen guide for AAC motif | gacgcaggttcctctagCttcgggagcagcg cacgtctccctgtagtcaag(SEQ ID NO: 470) | Has a 5' G for U6 expression | 7B |
| PFS binding screen non-targeting | GTAATGCCTGGCTTGTCGACGCATAGTCTG (SEQ ID NO: 471) | Has a 5' G for U6 expression | 7B |

TABLE 12-continued

Guide sequences used in this study for RNA editing in mammalian cells.
Mismatched base flips are capitalized

| Name | Spacer sequence | Notes | First FIG. |
|---|---|---|---|
| Motif preference targeting guide | gatagaatgactaaacCatcctgcggcctct actctgcattcaattacat(SEQ ID NO: 472) | Has a 5' G for U6 expression | 7C |
| Motif preference non-targeting guide | GTAATGCCTGGCTTGTCGACGCATAGTCTG (SEQ ID NO: 473) | Has a 5' G for U6 expression | 7C |
| PPIB tiling guide 50 mismatch distance | gCaaggccacaaaattatccactgggaacag tctaccgaagagac(SEQ ID NO: 474) | Has a 5' G for U6 expression | 13D |
| PPIB tiling guide 42 mismatch dtstance | gcctgtagcCaaggccacaaaattatccact gtttttggaacagtctacc(SEQ ID NO: 475) | Has a 5' G for U6 expression | 13D |
| PPIB tiling guide 34 mismatch distance | gctactctcctgtagcCaaggccacaaaatt atccactgttttggaaca(SEQ ID NO: 476) | Has a 5' G for U6 expression | 13D |
| PPIB tiling guide 26 mismatch distance | ggccaaatcctactctcctgtagcCaaggcc acaaaattatccactgta(SEQ ID NO: 477) | Has a 5' G for U6 expression | 13D |
| PPIB tiling guide 18 mismatch distance | gtttttgtagccaaatcctttctctcctgta gcCaaggccacaaaattatc(SEQ ID NO: 478) | Has a 5' G for U6 expression | 13D |
| PPIB tiling guide 10 mismatch distance | gatagctgtattgtagccaaatcctactctc ctgtagcCaaggccaca(SEQ ID NO: 479) | Has a 5' G for U6 expression | 13D |
| PPIB tiling guide 2 mismatch distance | gacgatggaatttgctggtagccaaatcctt tctctcctgtagcCa(SEQ ID NO: 480) | Has a 5' G for U6 expression | 13D |
| Targeting guide, opposite base G | gatagaatgactaaacGatcctgcggcctct actctgcattcaattacat(SEQ ID NO: 481) | Has a 5' G for U6 expression | 13D |
| Targeting guide, opposite base A | gatagaatgactaaacAatcctgcggcctct actctgcattcaattacat(SEQ ID NO: 482) | Has a 5' G for U6 expression | 13D |
| Targeting guide, opposite base C | gatagaatgactaaacTatcctgcggcctct actctgcattcaattacat(SEQ ID NO: 483) | Has a 5' G for U6 expression | 13D |
| AVPR2 guide 37 mismatch distance | ggtcccacgcggccCacagctgcaccaggaa gaagggtgcccagcacagca(SEQ ID NO: 484) | Has a 5' G for U6 expression | 8A |
| AVPR2 guide 35 mismatch distance | ggggtcccacgcggccCacagctgcaccagg aagaagggtgcccagcacag(SEQ ID NO: 485) | Has a 5' G for U6 expression | 8A |
| AVPR2 guide 33 mismatch distance | gccgggtcccacgcggccCacagctgcacca ggaagaagggtgcccagcac(SEQ ID NO: 486) | Has a 5' G for U6 expression | 8A |
| guide 37 mismatch distance | gggtgatgacatccCaggcgatcgtgtggcc tccaggagcccagagcagga(SEQ ID NO: 487) | Has a 5' G for U6 expression | 8B |
| FANCC guide 35 mismatch distance | gagggtgatgacatccCaggcgatcgtgtgg cctccaggagcccagagcag(SEQ ID NO: 488) | Has a 5' G for U6 expression | 8B |
| FANCC guide 32 mismatch distance | gatcagggtgatgacatccCaggcgatcgtg tggcctccaggagcccagag(SEQ ID NO: 489) | Has a 5' G for U6 expression | 8B |
| Synthetic disease gene target IL2RG | ggtggctccattcactcCaatgctgagcact tccacagagtgggttaaagc(SEQ ID NO: 490) | Has a 5' G for U6 expression | 8E |

TABLE 12-continued

Guide sequences used in this study for RNA editing in mammalian cells.
Mismatched base flips are capitalized

| Name | Spacer sequence | Notes | First FIG. |
|---|---|---|---|
| Synthetic disease gene target F8 | gtttctaatatagCcagactgatggactatt ctcaattaataatgat(SEQ ID NO: 491) | Has a 5' G for U6 expression | 8E |
| Synthetic disease gene target LDLR | gagatgttgctgtggatCcagtccacagcca gcccgtcggggcctggatg(SEQ ID NO: 492) | Has a 5' G for U6 expression | 8E |
| Synthetic disease gene target CBS | gcaggccggcccagctgCcaggtgcacctgc tcggagcatcgggccggatc(SEQ ID NO: 493) | Has a 5' G for U6 expression | 8E |
| Synthetic disease gene target HBB | gcaaagaacctctgggtCcaagggtagacca ccagcagcctgcccagggcc(SEQ ID NO: 494) | Has a 5' G for U6 expression | 8E |
| Synthetic disease gene target ALDOB | gaagagaaacttagtttCcagggctttggta gagggcaaaggttgatagca(SEQ ID NO: 495) | Has a 5' G for U6 expression | 8E |
| Synthetic disease gene target DMD | gtcagcctagtgcagagCcactggtagttgg tggttagagtttcaagttcc(SEQ ID NO: 496) | Has a 5' G for U6 expression | 8E |
| Synthetic disease gene target SMAD4 | ggctcattgtgaacaggCcagtaatgtccgg gatgggcggcataggcggg(SEQ ID NO: 497) | Has a 5' G for U6 expression | 8E |
| Synthetic disease gene target BRCA2 | gtagctaaagaacttgaCcaagacatatcag gatccacctcagctcctaga(SEQ ID NO: 498) | Has a 5' G for U6 expression | 8E |
| Synthetic disease gene target GRIN2A | ggggcattgttctgtgcCcagtcctgctggt agacctgctccccggtggct(SEQ ID NO: 499) | Has a 5' G for U6 expression | 8E |
| Synthetic disease gene target SCN9A | gagaagtcgttcatgtgCcaccgtgggagcg tacagtcatcattgatcttg(SEQ ID NO: 500) | Has a 5' G for U6 expression | 8E |
| Synthetic disease gene target TARDBP | gggattaatgctgaacgCaccaaagttcatc ccaccacccatattactacc(SEQ ID NO: 546) | Has a 5' G for U6 expression | 8E |
| Synthetic disease gene target CFTR | gctccaaaggctttcctCcactgttgcaaag ttattgaatcccaagacaca(SEQ ID NO: 501) | Has a 5' G for U6 expression | 8E |
| Synthetic disease gene target UBE3A | gatgaatgaacgatttcCcagaactccctaa tcagaacagagtccctggta(SEQ ID NO: 502) | Has a 5' G for U6 expression | 8E |
| Synthetic disease gene target SMPD1 | ggagcctctgccggagcCcagagaacccgag agtcagacagagccagcgcc(SEQ ID NO: 503) | Has a 5' G for U6 expression | 8E |
| Synthetic disease gene target USH2A | ggcttccgtggagacacCcaatcaatttgaa gagatcttgaagtgatgcca(SEQ ID NO: 504) | Has a 5' G for U6 expression | 8E |
| Synthetic disease gene target MEN1 | gtgggactgccctcctcCcatttgcagatgc cgtcgtagaatcgcagcagg(SEQ ID NO: 505) | Has a 5' G for U6 expression | 8E |
| Synthetic disease gene target C8orf37 | gcttcttcaatagttctCcagctacactggc aggcatatgcccgtgttcct(SEQ ID NO: 506) | Has a 5' G for U6 expression | 8E |
| Synthetic disease gene target MLH1 | gattccttttcttcgtcCcaattcacctcag tggctagtcgaagaatgaag(SEQ ID NO: 507) | Has a 5' G for U6 expression | 8E |

TABLE 12-continued

Guide sequences used in this study for RNA editing in mammalian cells.
Mismatched base flips are capitalized

| Name | Spacer sequence | Notes | First FIG. |
|---|---|---|---|
| Synthetic disease gene target TSC2 | gcagcttcagcaccttcCagtcagactcctg cttcaagcactgcagcagga(SEQ ID NO: 508) | Has a 5' G for U6 expression | 8E |
| Synthetic disease gene target NF1 | gccatttgcttgcagtgCcactccagaggat tccggattgccataaatact(SEQ ID NO: 509) | Has a 5' G for U6 expression | 8E |
| Synthetic disease gene target MSH6 | gttcaatagttaggtcCagtatcgtnacagc ccttcttggtagatttca(SEQ ID NO: 510) | Has a 5' G for U6 expression | 8E |
| Synthetic disease gene target SMN1 | ggcaaccgtcttctgacCaaatggcagaaca tttgtccccaactttccact(SEQ ID NO: 511) | Has a 5' G for U6 expression | 8E |
| Synthetic disease gene target SH3TC2 | gcgactttccaatgaacCactgaagcccagg tatgacaaagccgatgatct(SEQ ID NO: 512) | Has a 5' G for U6 expression | 8E |
| Synthetic disease gene target DNAH5 | gtttacactcatgcttcCacagctttaacag atcatttggttccttgatga(SEQ ID NO: 513) | Has a 5' G for U6 expression | 8E |
| Synthetic disease gene target MECP2 | gcttaagcttccgtgtcCagccttcaggcag ggtggggtcatcatacatgg(SEQ ID NO: 514) | Has a 5' G for U6 expression | 8E |
| Synthetic disease gene target ADGRV1 | ggacagctgggctgatcCatgatgtcatcca gaaacactggggaccctcag(SEQ ID NO: 515) | Has a 5' G for U6 expression | 8E |
| Synthetic disease gene target AHI1 | gtctcatctcaactttcCatatccgtatcat ggaatcatagcatcctgtaa(SEQ ID NO: 516) | Has a 5' G for U6 expression | 8E |
| Synthetic disease gene target PRKN | gcatgcagacgcggttcCactcgcagccaca gttccagcaccactcgagcc(SEQ ID NO: 517) | Has a 5' G for U6 expression | 8E |
| Synthetic disease gene target COL3A1 | gttggttagggtcaaccCagtattctccact cttgagttcaggatggcaga(SEQ ID NO: 518) | Has a 5' G for U6 expression | 8E |
| Synthetic disease gene target BRCA1 | gctacactgtccaacacCcactctcgggtca ccacaggtgcctcacacatc(SEQ ID NO: 519) | Has a 5' G for U6 expression | 8E |
| Synthetic disease gene target MYBPC3 | gctgcactgtgtaccccCagagctccgtgtt gccgacatcctggggtggct(SEQ ID NO: 520) | Has a 5' G for U6 expression | 8E |
| Synthetic disease gene target APC | gagcttcctgccactccCaacaggtttcaca gtaagcgcgtatctgttcca(SEQ ID NO: 521) | Has a 5' G for U6 expression | 8E |
| Synthetic disease gene target BMPR2 | gacggcaagagcttaccCagtcacttgtgtg gagacttaaatacttgcata(SEQ ID NO: 522) | Has a 5' G for U6 expression | 8E |
| KRAS tiling guide 50 mismatch distance | gCaaggccacaaaattatccactgggaacag tctaccgaagagac(SEQ ID NO: 523) | Has a 5' G for U6 expression | 9A |
| KRAS tiling guide 42 mismatch distance | gcctgtagcCaaggccacaaaattatccact gttttttggaacagtctacc(SEQ ID NO: 524) | Has a 5' G for U6 expression | 9A |
| KRAS tiling guide 34 mismatch distance | gctactctcctgtagcCaaggccacaaaatt atccactgttttttggaaca(SEQ ID NO: 525) | Has a 5' G for U6 expression | 9A |

TABLE 12-continued

Guide sequences used in this study for RNA editing in mammalian cells.
Mismatched base flips are capitalized

| Name | Spacer sequence | Notes | First FIG. |
|---|---|---|---|
| KRAS tiling guide 26 mismatch distance | ggccaaatcctttctctcctgtagcCaaggc cacaaaattatccactgttt(SEQ ID NO: 526) | Has a 5' G for U6 expression | 9A |
| KRAS tiling guide 18 mismatch distance | gttttgtagccaaatcctttctctcctgta gcCaaggccacaaaattatc(SEQ ID NO: 527) | Has a 5' G for U6 expression | 9A |
| KRAS tiling guide 10 mismatch distance | gatttgctgttatgtagccaaatcctactct cctgtagcCaaggccaca(SEQ ID NO: 528) | Has a 5' G for U6 expression | 9A |
| KRAS tiling guide 2 mismatch distance | gacgatggaatttgctggtagccaaatcctt tctctcctgtagcCa(SEQ ID NO: 529) | Has a 5' G for U6 expression | 9A |
| KRAS tiling non-targeting guide | GTAATGCCTGGCTTGTCGACGCATAGTCTG (SEQ ID NO: 530) | Has a 5' G for U6 expression | 9A |
| Luciferase W85X targeting guide for transcriptome specificity | gatagaatgttctaaacCatcctgcggcctc tactctgcattcaattacat(SEQ ID NO: 531) | Has a 5' G for U6 expression | 53B |
| Non-targeting guide for transcriptome specificity | GCAGGGTTTTCCCAGTCACGACGTTGTAAAG TTG(SEQ ID NO: 532) | Has a 5' G for U6 expression | 9C |
| endogenous KRAS guide 2 | gtcaaggcactcttgccCacgccaccagctc caactaccacaagtttatat(SEQ ID NO: 533) | Has a 5' G for U6 expression | 10F |
| endogenous PPIB guide 1 | gcaaagatcacccggccCacatcttcatctc caattcgtaggtcaaaatac(SEQ ID NO: 534) | Has a 5' G for U6 expression | 10G |
| endogenous KRAS guide 1 | GcgccaccagctccaacCaccacaagtttat attcagtcattttcagcagg(SEQ ID NO: 535) | Has a 5' G for U6 expression | 10F |
| endogenous KRAS guide 3 | GtactccatcaattacCacttgcttcctgta ggaatcctctattGTtgga(SEQ ID NO: 536) | Has a 5' G for U6 expression | 10F |
| endogenous PPIB guide 2 | GctactctcctgtagcCaaggccacaaaatt atccactgttttggaaca(SEQ ID NO: 537) | Has a 5' G for U6 expression | 10G |
| endogenous non-targeting guide | GTAATGCCTGGCTTGTCGACGCATAGTCTG (SEQ ID NO: 538) | Has a 5' G for U6 expression | 10F |
| BoxB Cluc guide | tctaccataGGCCCTGAAAAAGGGCCtgttc taaacCatcctgcggcctctactcGGCCCTG AAAAAGGGCCattcaattac(SEQ ID NO: 539) | Has a 5' G for U6 expression | 18B |
| BoxB non-targeting guide | cagctggcgaGGCCCTGAAAAAGGGCCgggg atgtgcCgcaaggcgattaagttggGGCCCT GAAAAAGGGCCacgccagggt(SEQ ID NO: 540) | Has a 5' G for U6 expression | 18B |
| Stafforst full length ADAR2 guide 1 | GTGGAATAGTATAACAATATGCTAAATGTTG TTATAGTATCCCACtctaaaCCAtcctgcgG GGCCCTCTTCAGGGCCC(SEQ ID NO: 541) | Has a 5' G for U6 expression | 18C |
| Stafforst full length ADAR2 non-targeting guide | GTGGAATAGTATAACAATATGCTAAATGTTG TTATAGTATCCCACaccctggcgttacccaG GGCCCTCTTCAGGGCCC(SEQ ID NO: 542) | Has a 5' G for U6 expression | 18C |

REFERENCES

1. P. D. Hsu, E. S. Lander, F. Zhang, Development and applications of CRISPR-Cas9 for genome engineering. Cell 157, 1262-1278 (2014).
2. A. C. Komor, A. H. Badran, D. R. Liu, CRISPR-Based Technologies for the Manipulation of Eukaryotic Genomes. Cell 168, 20-36 (2017).
3. L. Cong et al., Multiplex genome engineering using CRISPR/Cas systems. Science 339, 819-823 (2013).
4. P. Mali et al., RNA-guided human genome engineering via Cas9. Science 339, 823-826 (2013).
5. B. Zetsche et al., Cpf1 is a single RNA-guided endonuclease of a class 2 CRISPR-Cas system. Cell 163, 759-771 (2015).
6. H. Kim, J. S. Kim, A guide to genome engineering with programmable nucleases. Nat Rev Genet 15, 321-334 (2014).
7. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
8. K. Nishida et al., Targeted nucleotide editing using hybrid prokaryotic and vertebrate adaptive immune systems. Science 353 (2016).
9. Y. B. Kim et al., Increasing the genome-targeting scope and precision of base editing with engineered Cas9-cytidine deaminase fusions. Nat Biotechnol 35, 371-376 (2017).
10. O. O. Abudayyeh et al., C2c2 is a single-component programmable RNA-guided RNA-targeting CRISPR effector. Science 353, aaf5573 (2016).
11. S. Shmakov et al., Discovery and Functional Characterization of Diverse Class 2 CRISPR-Cas Systems. Mol Cell 60, 385-397 (2015).
12. S. Shmakov et al., Diversity and evolution of class 2 CRISPR-Cas systems. Nat Rev Microbiol 15, 169-182 (2017).
13. A. A. Smargon et al., Cas13b Is a Type VI-B CRISPR-Associated RNA-Guided RNase Differentially Regulated by Accessory Proteins Csx27 and Csx28. Mol Cell 65, 618-630 e617 (2017).
14. J. S. Gootenberg et al., Nucleic acid detection with CRISPR-Cas13a/C2c2. Science 356, 438-442 (2017).
15. O. O. Abudayyeh et al., RNA targeting with CRISPR-Cas13a. Nature in press, (2017).
16. K. Nishikura, Functions and regulation of RNA editing by ADAR deaminases. Annu Rev Biochem 79, 321-349 (2010).
17. B. L. Bass, H. Weintraub, An unwinding activity that covalently modifies its double-stranded RNA substrate. Cell 55, 1089-1098 (1988).
18. M. M. Matthews et al., Structures of human ADAR2 bound to dsRNA reveal base-flipping mechanism and basis for site selectivity. Nat Struct Mol Biol 23, 426-433 (2016).
19. A. Kuttan, B. L. Bass, Mechanistic insights into editing-site specificity of ADARs. Proc Natl Acad Sci USA 109, E3295-3304 (2012).
20. S. K. Wong, S. Sato, D. W. Lazinski, Substrate recognition by ADAR1 and ADAR2. RNA 7, 846-858 (2001).
21. M. Fukuda et al., Construction of a guide-RNA for site-directed RNA mutagenesis utilising intracellular A-to-I RNA editing. Sci Rep 7, 41478 (2017).
22. M. F. Montiel-Gonzalez, I. Vallecillo-Viejo, G. A. Yudowski, J. J. Rosenthal, Correction of mutations within the cystic fibrosis transmembrane conductance regulator by site-directed RNA editing. Proc Natl Acad Sci USA 110, 18285-18290 (2013).
23. M. F. Montiel-Gonzalez, I. C. Vallecillo-Viejo, J. J. Rosenthal, An efficient system for selectively altering genetic information within mRNAs. Nucleic Acids Res 44, e157 (2016).
24. J. Wettengel, P. Reautschnig, S. Geisler, P. J. Kahle, T. Stafforst, Harnessing human ADAR2 for RNA repair—Recoding a PINK1 mutation rescues mitophagy. Nucleic Acids Res 45, 2797-2808 (2017).
25. Y. Wang, J. Havel, P. A. Beal, A Phenotypic Screen for Functional Mutants of Human Adenosine Deaminase Acting on RNA 1. ACS Chem Biol 10, 2512-2519 (2015).
26. K. A. Lehmann, B. L. Bass, Double-stranded RNA adenosine deaminases ADAR1 and ADAR2 have overlapping specificities. Biochemistry 39, 12875-12884 (2000).
27. Y. Zheng, C. Lorenzo, P. A. Beal, DNA editing in DNA/RNA hybrids by adenosine deaminases that act on RNA. Nucleic Acids Res 45, 3369-3377 (2017).
28. K. Gao et al., A de novo loss-of-function GRIN2A mutation associated with childhood focal epilepsy and acquired epileptic aphasia. PLoS One 12, e0170818 (2017).
29. H. M. Lanoiselee et al., APP, PSEN1, and PSEN2 mutations in early-onset Alzheimer disease: A genetic screening study of familial and sporadic cases. PLoS Med 14, e1002270 (2017).
30. C. Ballatore, V. M. Lee, J. Q. Trojanowski, Tau-mediated neurodegeneration in Alzheimer's disease and related disorders. Nat Rev Neurosci 8, 663-672 (2007).
31. Y. Li et al., Carriers of rare missense variants in IFIH1 are protected from psoriasis. J Invest Dermatol 130, 2768-2772 (2010).
32. R. S. Finkel et al., Treatment of infantile-onset spinal muscular atrophy with nusinersen: a phase 2, open-label, dose-escalation study. Lancet 388, 3017-3026 (2016).

Example 4 Additional Type VI-B Effectors

TABLE 13

| | |
|---|---|
| *Paludibacter propionicigenes* WB4 (NC_014734.1) >WP_013446107 | mktsanniyfnginsfkkifdskgaiapiaekscrnfdikaqndvnkegrihyfavghtf kqldtenlfeyvldenlrakrptrfislqqfdkefienikrlisdirninshyihrfdpl kidavptniidflkesfelaviqiylkekginylqfsenphadqklvaflhdkflpldek ktsmlqnetpqlkeykeyrkyfktlskqaaidqllfaeketdyiwnlfdshpvltisagk ylsfysclfllsmflykseangliskikgfkkntteeekskreiftffskrfnsmdidse enqlvkfrdlilylnhypvawnkdleldssnpamtdklkskiieleinrsfplyegnerf atfakyqiwgkkhlgksiekeyinasftdeeitaytyetdtcpelkdahkkladlkaakg lfgkrkeknesdikktetsirelqhepnpikdkliqrieknlltvsygrnqdrfmdfsar flaeinyfgqdasfkmyhfyatdeqnselekyelpkdkkkydslkfhqgklvhfisykeh lkryeswddafviennaiqlklsfdgventvtiqralliylledalrniqnntaenagkq llqeyyshnkadlsafkqiltqqdsiepqqktefkkllprrllnnyspainhlqtphssl plilekallaekrycslvvkakaegnyddfikrnkgkqfklqfirkawnlmyfrnsylqn |

| | |
|---|---|
| | vqaaghhksfhierdefndfsrymfafeelsqykyylnemfekkgffennefkilfqsgt<br>slenlyekkqkfeiwlasntaktnkpdnyhlnnyeqqfsnqlffinlshfinylkstgk<br>lqtdangqiiyealnnvqylipeyyytdkpersesksgnklynklkatkledallyemam<br>cylkadkqiadkakhpitklltsdvefnitnkegiqlyhllvpfkkidafiglkmhkeqq<br>dkkhptsflanivnylelvkndkdirktyeafstnpvkrtltyddlakidghlisksikf<br>tnvtleleryfifkeslivkkgnnidfkyikglrnyynnekkknegirnkafhfgipdsk<br>sydglirdaevmfianevkpthatkytdlnkqlhtvcdklmetvhndyfskegdgkkkre<br>aagqkyfeniisak (SEQ ID NO: 547) |
| *Prevotella*<br>sp. P5-60<br>(NZ_JXQJ01000080.1)<br>>WP_044074780.1 | mnipalvenqkkyfgtysvmamlnaqtvldhiqkvadiegegnennenlwfhpvmshlyn<br>akngydkqpektmfiierlqsyfpflkimaenqreysngkykqnrvevnsndifevlkra<br>fgvlkmyrdltnhyktyeeklidgcefltsteqpfsgmiskyytvalrntkerygykaed<br>lafiqdnrykftkdaygkrksqvntgsflslqdyngdttkklhlsgvgialliclfldkq<br>yinlflsrlpifssynaqseerriiirsfginsikqpkdrihseksnksvamdmlnevkr<br>cpdelfttlsaekqsrfriisddhnevlmkrssdrfvplllqyidygklfdhirfhvnmg<br>klryllkadktcidgqtrvrvieqpingfgrleevetmrkqengtfgnsgirirdfenmk<br>rddanpanypyivetythyilennkvemfisdeenptpllpvieddryvvktipscrmst<br>leipamafhmflfgsektekliidvhdrykrlfqamqkeevtaeniasfgiaesdlpqki<br>mdlisgnahgkdvdafirltvddmltdterrikrfkddrksirsadnkmgkrgfkgistg<br>kladflakdivlfqpsvndgenkitglnyrimqsaiavydsgddyeakqqfklmfekarl<br>igkgttephpflykvfvrsipanavdfyerylierkfyliglsneikkgnrvdvpfirrd<br>qnkwktpamktlgriysedlpvelprqmfdneikshlkslpqmegidfnnanvtyliaey<br>mkrvinddfqtfyqwkrnyrymdmlrgeydrkgslqhcftsieeereglwkerasrteryr<br>klasnkirsnrqmrnasseeietildkrlsncrneyqksekiirryrvqdallflllakkt<br>lteladfdgerfklkeimpdaekgilseimpmsftfekggkiytitsggmklknygdffv<br>lasdkrignllelvgsntvskedimeefkkydqcrpeissivfnlekwafdtypelpary<br>drkekvdfwsildvlsnnkdinneqsyilrkirnafdhnnypdkgiveikalpeiamsik<br>kafgeyaimk (SEQ ID NO: 548) |
| *Prevotella*<br>sp. P4-76<br>(NZ_JXQI01000021.1)<br>>WP_044072147.1 | mnipalvenqkkyfgtysvmamlnaqtvldhiqkvadiegegnennenlwfhpvmshlyn<br>akngydkqpektmfiierlqsyfpflkimaenqreysngkykqnrvevnsndifevlkra<br>fgvlkmyrdqashyktydeklidgcefltsteqplsgminnyytvalrnmnerygykted<br>lafiqdkrfkfvkdaygkkksqvntgfflslqdyngdtqkklhlsgvgialliclfldkq<br>yiniflsrlpifssynaqseerriiirsfginsikqpkdrihseksnksvamdmlneikr<br>cpnelfetlsaekqsrfriisndhnevlmkrssdrfvplllqyidygklfdhirfhvnmg<br>klryllkadktcidgqtrvrvieqpingfgrleevetmrkqengtfgnsgirirdfenmk<br>rddanpanypyivdtythyilennkvemfisdeetpapllpvieddryvvktipscrmst<br>leipamafhmflfgskktekliivdvhnrykrlfkamqkeevtaeniasfgiaesdlpqki<br>idlisgnahgkdvdafirltvddmladterrikrfkddrksirsadnkmgkrgfkgistg<br>kladflakdivlfqpsvndgenkitglnyrimqsaiavynsgddyeakqqfklmfekarl<br>igkgttephpflykvfvrsipanavdfyerylierkfyliglsneikkgnrvdvpfirrd<br>qnkwktpamktlgriydedlpvelprqmfdneikshlkslpqmegidfnnanvtyliaey<br>mkrvinddfqtfyqwkrnyrymdmlrgeydrkgslqscftsveeereglwkerasrteryr<br>klasnkirsnrqmrnasseeietildkrlsnsrneyqksekvirryrvqdallflllakkt<br>lteladfdgerfklkeimpdaekgilseimpmsftfekggkkytitsegmklknygdffv<br>lasdkrignllelvgsdtvskedimeefkkydqcrpeissivfnlekwafdtypelsary<br>dreekvdfksilkillnnkninkeqsdilrkirnafdhnnypdkgvveiralpeiamsik<br>kafgeyaimk (SEQ ID NO: 549) |
| *Prevotella*<br>sp. P5-125<br>(NZ_JXQL01000055.1)<br>>WP_044065294.1 | mnipalvenqkkyfgtysvmamlnaqtvldhiqkvadiegegnennenlwfhpvmshlyn<br>akngydkqpektmfiierlqsyfpflkimaenqreysngkykqnrvevnsndifevlkra<br>fgvlkmyrdltnhyktyeeklndgcefltsteqplsgminnyytvalrnmnerygykted<br>lafiqdkrfkfvkdaygkkksqvntgfflslqdyngdtqkklhlsgvgialliclfldkq<br>yiniflsrlpifssynaqseerriiirsfginsiklpkdrihseksnksvamdmlnevkr<br>cpdelfttlsaekqsrfriisddhnevlmkrssdrfvplllqyidygklfdhirfhvnmg<br>klryllkadktcidgqtrvrvieqpingfgrleeaetmrkqengtfgnsgirirdfenmk<br>rddanpanypyivdtythyilennkvemfindkedsapllpvieddryvvktipscrmst<br>leipamafhmflfgskktekliivdvhnrykrlfqamqkeevtaeniasfgiaesdlpqki<br>ldlisgnahgkdvdafirltvddmltdterrikrfkddrksirsadnkmgkrgfkgistg<br>kladflakdivlfqpsvndgenkitglnyrimqsaiavydsgddyeakqqfklmfekarl<br>igkgttephpflykvfarsipanavefyerylierkfyltglsneikkgnrvdvpfirrd<br>qnkwktpamktlgriysedlpvelprqmfdneikshlkslpqmegidfnnanvtyliaey<br>mkrvldddfqtfyqwnrnyrymdmlkgeydrkgslqhcftsveeereglwkerasrteryr<br>kgasnkirsnrqmrnasseeietildkrlsnsrneyqksekvirryrvqdallflllakkt<br>lteladfdgerfklkeimpdaekgilseimpmsftfekggkkytitsegmklknygdffv<br>lasdkrignllelvgsdivskedimeefnkydqcrpeissivfnlekwafdtypelsary<br>dreekvdfksilkillnnkninkeqsdilrkirnafdhnnypdkgvveikalpeiamsik<br>kafgeyaimk (SEQ ID NO: 550) |
| *Prevotella*<br>sp. P5-119<br>(NZ_JXQK01000043.1)<br>>WP_042518169.1 | mnipalvenqkkyfgtysvmamlnaqtvldhiqkvadiegegnennenlwfhpvmshlyn<br>akngydkqpektmfiierlqsyfpflkimaenqreysngkykqnrvevnsndifevlkra<br>fgvlkmyrdltnhyktyeeklidgcefltsteqplsgmiskyytvalrntkerygykted<br>lafiqdnikkitkdaygkrksqvntgfflslqdyngdtqkklhlsgvgialliclfldkq<br>yiniflsrlpifssynaqseerriiirsfginsiklpkdrihseksnksvamdmlnevkr<br>cpdelfttlsaekqsrfriisddhnevlmkrstdrfvplllqyidygklfdhirfhvnmg<br>klryllkadktcidgqtrvrvieqpingfgrleeaetmrkqengtfgnsgirirdfenvk<br>rddanpanypyivdtythyilennkvemfisdkgssapllplieddryvvktipscrmst<br>leipamafhmflfgskktekliivdvhnrykrlfqamqkeevtaeniasfgiaesdlpqki<br>ldlisgnahgkdvdafirltvddmltdterrikrfkddrksirsadnkmgkrgfkgistg<br>kladflakdivlfqpsvndgenkitglnyrimqsaiavydsgddyeakqqfklmfekarl |

TABLE 13-continued

| | |
|---|---|
| | igkgttephpflykvfarsipanavdfyerylierkfyltglcneikrgnrvdvpfirrd<br>qnkwktpamktlgriysedlpvelprqmfdneikshlkslpqmegidfnnanvtyliaey<br>mkrvinddfqtfyqwkrnyhymdmlkgeydrkgslqhcftsveereglwkerasrteryr<br>klasnkirsnrqmrnasseeietildkrlsncrneyqksekvirryrvqdallfllakkt<br>lteladfdgerfklkeimpdaekgilseimpmsftfekggkkytitsegmklknygdffv<br>lasdkrignllelvgsdivskedimeefnkydqcrpeissivfnlekwafdtypelsary<br>dreekvdfksilkillnnkninkeqsdilrkirnafdhnnypdkgiveikalpeiamsik<br>kafgeyaimk (SEQ ID NO: 551) |
| *Capnocytophaga canimorsus* Cc5<br>(NC_015846<br>>WP_013997271A | mkniqrlgkgnefspfkkedkfyfggflnlannniedffkeiitrfgivitdenkkpket<br>fgekilneifkkdisivdyekwvnifadyfpftkylslyleemqfknrvicfrdvmkell<br>ktvealrnfythydhepikiedrvfyfldkvildvsltvknkylktdktkeflnqhigee<br>lkelckqrkdylvgkgkridkeseiingiynnafkdfickrekqddkenhnsvekilcnk<br>epqnkkqkssatvwelcsksssskyteksfpnrendkhclevpisqkgivfllsfflnkge<br>iyaltsnikgfkakitkeepvtydknsirymathrmfsflaykglkrkirtseinynedg<br>qasstyeketlmlqmldelnkvpdvvyqnlsedvqktfiedwneylkenngdvgtmeeeq<br>vihpvirkryedkfnyfairfldefaqfptlrfqvhlgnylcdkrtkqicdttterevkk<br>kitvfgrlselenkkaiflnereeikgwevfpnpsydfpkenisvnykdfpivgsildre<br>kqpvsnkigirvkiadelgreidkaikekklrnpknrkanqdekqkerlvneivstnsne<br>qgepvvfigqptaylsmndihsvlyeflinkisgealetkivekietqikqiigkdattk<br>ilkpytnansnsinrekllrdleqeqqilktlleeqqqrekdkkdkkskrkhelypsekg<br>kvavwlandikrfmpkafkeqwrgyhhsllqkylayyeqskeelknllpkevfkhfpfkl<br>kgyfqqqylnqfytdylkrrlsyvnelllniqnfkndkdalkatekecfkffrkqnyiin<br>piniqiqsilvypiflkrgfldekptmidrekfkenkdteladwfmhyknykednyqkfy<br>ayplekveekekfkrnkqinkqkknkndvytlmmveyiiqkifgdkfveenplvlkgifqsk<br>aerqqnnthaattgerningilnqpkdikiqgkitvkgvklkdignfrkyeidqrvntfl<br>dyeprkewmaylpndwkekekqgqlppnnvidrgiskyetvrskillkdvqelekiisde<br>ikeehrhdlkqgkyynfkyyilngllrqlknenvenykvfklntnpekvnitqlkqeatd<br>legkafvltyirnkfahnqlpkkefwdycqekygkiekektyaeyfaevfkrekealik<br>(SEQ ID NO: 552) |
| *Phaeodactylibacter xiamenensis*<br>(NZ_JPOS01000018.1)<br>>WP_044218239.1 | mtntpkrrtlhrhpsyfgaflniarhnafmimehlstkydmedkntldeaqlpnaklfgc<br>lkkrygkpdvtegvsrdlrryfpflnyplflhlekqqnaeqaatydinpedieftlkgff<br>rllnqmrnnyshyisntdygkfdklpvgdiyeaaifrlldrgkhtkrfdvfeskhtrhle<br>snnseyrprslanspdhentvafvtclflerkyafpflsrldcfrstndaaegdplirka<br>shecytmfccrlpqpkklessdilldmvnelgrcpsalynllseedgarfhikreeitgfe<br>edpdeelegeivlkrhsdrfpyfalryfddteafqtlrfdvylgrwrtkpvykkriygge<br>rdrvltqsirtftrlsrllpiyenvkhdavrqneedgklvnpdvtsqfhkswiqiesddr<br>aflsdriehfsphynfgdqviglkfinpdryaaiqnvfpklpgeekkdkdaklvnetada<br>iistheirslflyhylskkpisagderrfiqvdtetfikqyidtikIffediksgelqpi<br>adppnyqkneplpyvrgdkektqeeraqyrerqkeikerrkelntllqnryglsiqyips<br>rlreyllgykkvpyeklalqklraqrkevkrikdiekmrtprvgeqatwlaedivfltp<br>pkmhtperkttthpqklnndqfrimqsslayfsvnkkaikkffqketgiglsnretshpf<br>lyridvgrcrgildfytgylkykmdwlddaikkvdnrkhgkkeakkyekylpssiqhktp<br>leldytrlpvylprglfkkaivkalaahadfqvepeednvifcldqlldgdtqdfynwqr<br>yyrsalteketdnqlvlahpyaegilgtiktlegkqknnklgnkakqkikdelidlkrak<br>rrlldreqylravqaedralwlmiqerqkqkaeheeiafdqldlknitkiltesidarlr<br>ipdtkvditdklplrrygdlrrvakdrrlvnlasyyhvaglseipydlvkkeleeydrrr<br>vaffehvyqfekevydryaaelrnenpkgestyfshweyvavavkhsadthfnelfkekv<br>mqlrnkfhhnefpyfdwllpevekasaalyadrvfdvaegyyqkmrklmrq (SEQ ID NO: 553) |
| *Porphyromonas gingivalis* W83<br>(NC_002950.2)<br>>WP_005873511.1 | mntvpasenkgqsrtveddpqyfglylnlarenlieveshvrikfgkkklneeslkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkecltvsglafficlfldreqasgmlsrirgfkrtdenwaravhetfcdlc<br>irhphdrlessntkealldmlnelnrcprilydmlpeeeraqflpaldensmnnlsens<br>lneesrllwdgssdwaealtkrirhqdrfpylmlrfieemdllkgirfrvdlgeieldsy<br>skkvgrngeydrtitdhalafgklsdfqneeevsrmisgeasypvrfslfapryaiydnk<br>igychtsdpvypksktgekralsnpqsmgfisvhnlrklllmellcegsfsrmqsdflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgematflsqdivrmiiseetkklitsayynemqrslaqyageenrrqfraivae<br>lhlldpssghpflsatmetahrytedfykcylekkrewlaktfyrpeqdentkrrisvff<br>vpdgearkllplirrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaadikrsfhravnerefmlrlvqeddrlmlmainkmmtdreedilpg<br>lknidsildeenqfslavhakvlekegeggdnslslvpatieikskrkdwskyiryrydr<br>rvpglmshfpehkatldevkttllgeydrcrikifdwafalegaimsdrdlkpylhesssr<br>egksgehstivkmlvekkgcltpdesqyliirnkaahnqfpcaaempliyrdvsakvgs<br>iegssakdlpegsslvdslwkkyemiirkilpildpenrffgkllnnmsqpindl (SEQ ID NO: 554) |
| *Porphyromonas gingivalis* F0570<br>(NZ_KI259168.1)<br>>WP_021665475.1 | mntvpasenkgqsrtveddpqyfglylnlarenlieveshvrikfgkkklneeslkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkecltvsglafficlfldreqasgmlsrirgfkrtnenwaravhetfcdlc<br>irhphdrlessntkealldmlnelnrcprilydmlpeeeraqflpaldensmnnlsens<br>lneesrllwdgssdwaealtkrirhqdrfpylmlrfieemdllkgirfrvdlgeieldsy<br>skkvgrngeydrtitdhalafgklsdfqneeevsrmisgeasypvrfslfapryaiydnk |

TABLE 13-continued

| | |
|---|---|
| | igychtsdpvypksktgekralsnpqsmgfisvhdlrklllmellcegsfsrmqsgflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgematflsqdivrmiiseetkklitsayynemqrslaqyageenrrqfraivae<br>lhlldpssghpflsatmetahrytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaaadikrsfhravnerefmlrlvqeddrlmlmainkmmtdreedilpg<br>lknidsildekenqfslavhakvlekegeggdnslslvpatieikskrkdwskyiryrydr<br>rvpglmshfpehkatldevktllgeydrcrikifdwafalegaimsdrdlkpylhesssr<br>egksgehstivkmlvekkgcltpdesqylilirnkaahnqfpcaaempliyrdvsakvgs<br>iegssakdlpegsslvdslwkkyemiirkilpildhenrffgkllnnmsqpindl (SEQ ID NO: 555) |
| *Porphyromonas gingivalis* ATCC 33277 (NC_010729.1) >NV_P012458151.1 | mntvpasenkgqsrtveddpqyfglylnlarenlieveshvrikfgkkklneeslkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfavffkpddfvlaknrk<br>eqlisvadgkecltvsgfafficlfldreqasgmlsrirgfkrtdenwaravhetfcdlc<br>irhphdrlessntkeallldmlnelnrcprilydmlpeeeraqflpaldensmnnlsens<br>ldeesrllwdgssdwaealtkrirhqdrfpylmlrfieemdllkgirfrvdlgeieldsy<br>skkvgrngeydrtitdhalafgklsdfqneeevsrmisgeasypvrfslfapryaiydnk<br>igychtsdpvypksktgekralsnpqsmgfisvhdlrklllmellcegsfsrmqsdflrk<br>anrildetaegklqfsalfpemrhrfippqnpkskdrrekaettlekykqeikgrkdkln<br>sqllsafdmdqrqlpsrlldewmnirpashsvklrtyvkqlnedcrlrlrkfrkdgdgka<br>raiplvgematflsqdivrmiiseetkklitsayynemqrslaqyageenrrqfraivae<br>lrlldpssghpflsatmetahrytegfykcylekkrewlakifyrpeqdentkrrisvff<br>vpdgearkllpllirrrmkeqndlqdwirnkqahpidlpshlfdskvmellkvkdgkkkw<br>neafkdwwstkypdgmqpfyglrrelnihgksysyipsdgkkfadcythlmektvrdkkr<br>elrtagkpvppdlaaadikrsfhravnerefmlrlvqeddrlmlmainkmmtdreedilpg<br>lknidsildeenqfslavhakvlekegeggdnslslvpatieikskrkdwskyiryrydr<br>rvpglmshfpehkatldevktllgeydrcrikifdwafalegaimsdrdlkpylhesssr<br>egksgehstivkmlvekkgcltpdesqylilirnkaahnqfpcaaempliyrdvsakvgs<br>iegssakdlpegsslvdslwkkyemiirkilpildpenrffgkllnnmsqpindl (SEQ ID NO: 556) |
| *Porphyromonas gingivalis* F0185 (AWVC01000122.1) >ERJ81987.1 | mntvpasenkgqsrtveddpqyfglylnlarenlieveshvrikfgkkklneeslkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkecltvsglafficlfldreqasgmlsrirgfkrtdenwaravhetfcdlc<br>irhphdrlessntkeallldmlnelnrcprilydmlpeeeraqflpaldensmnnlsens<br>lneesrllwdgssdwaealtkrirhqdrfpylmlrfieemdllkgirfrvdlgeieldsy<br>skkvgrngeydrtitdhalafgklsdfqneeevsrmisgeasypvrfslfapryaiydnk<br>igychtsdpvypksktgekralsnpqsmgfisvhdlrklllmellcegsfsrmqsgflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgematflsqdivrmiiseetkklitsayynemqrslaqyageenrrqfraivae<br>lhlldpssghpflsatmetahrytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaaadikrsfhravnerefmlrlvqeddrlmlmainkmmtdreedilpg<br>lknidsildeenqfslavhakvlekegeggdnslslvpatieikskrkdwskyiryrydr<br>rvpglmshfpehkatldevktllgeydrcrikifdwafalegaimsdrdlkpylhesssr<br>egksgehstivkmlvekkgcltpdesqylilirnkaahnqfpcaaempliyrdvsakvgs<br>iegssakdlpegsslvdslwkkyemiirkilpildhenrffgkllnnmsqpindl (SEQ ID NO: 557) |
| *Porphyromonas gingivalis* F0185 (NZ_K1259960.1) >WP_021677657.1 | mntvpasenkgqsrtveddpqyfglylnlarenlieveshvrikfgkkklneeslkqsll<br>cdhllsvdrwtkvyghsrrylpflhyfdpdsqiekdhdsktgvdpdsaqrlirelyslld<br>flrndfshnrldgttfehlevspdissfitgtyslacgraqsrfadffkpddfvlaknrk<br>eqlisvadgkecltvsglafficlfldreqasgmlsrirgfkrtdenwaravhetfcdlc<br>irhphdrlessntkeallldmlnelnrcprilydmlpeeeraqflpaldensmnnlsens<br>lneesrllwdgssdwaealtkrirhqdrfpylmlrfieemdllkgirfrvdlgeieldsy<br>skkvgrngeydrtitdhalafgklsdfqneeevsrmisgeasypvrfslfapryaiydnk<br>igychtsdpvypksktgekralsnpqsmgfisvhdlrklllmellcegsfsrmqsgflrk<br>anrildetaegklqfsalfpemrhrfippqnpkskdrrekaettlekykqeikgrkdkln<br>sqllsafdmnqrqlpsrlldewmnirpashsvklrtyvkqlnedcrlrlrkfrkdgdgka<br>raiplvgematflsqdivrmiiseetkklitsayynemqrslaqyageenrrqfraivae<br>lhlldpssghpflsatmetahrytedfykcylekkrewlaktfyrpeqdentkrrisvff<br>vpdgearkllpllirrrmkeqndlqdwirnkqahpidlpshlfdskimellkvkdgkkkw<br>neafkdwwstkypdgmqpfyglrrelnihgksysyipsdgkkfadcythlmektvqdkkr<br>elrtagkpvppdlaaadikrsfhravnerefmlrlvqeddrlmlmainkmmtdreedilpg<br>lknidsildeenqfslavhakvlekegeggdnslslvpatieikskrkdwskyiryrydr<br>rvpglmshfpehkatldevktllgeydrcrikifdwafalegaimsdrdlkpylhesssr<br>egksgehstivkmlvekkgcltpdesqylilirnkaahnqfpcaaempliyrdvsakvgs<br>iegssakdlpegsslvdslwkkyemiirkilpildhenrffgkllnnmsqpindl (SEQ ID NO: 558) |

TABLE 13-continued

| | |
|---|---|
| Porphyromonas gingivalis SJD2 (NZ_K1629875.1) >WP_023846767.1 | mntvpasenkgqsrtveddpqyfglylnlarenlieveshvrikfgkkklneeslkqsll cdhllsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkeallldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnprsmgfisvhdlrklllmellcegsfsrmqsdflrk anrildetaegklqfsalfpemrhrfippqnpkskdrrekaettlekyqkeikgrkdkln sqllsafdmnqrqlpsrlldewmnirpashsvklrtyvkqlnedcrlrlrkfrkdgdgka raiplvgematflsqdivrmiiseetkklitsayynemqrslaqyageenrrqfraivae lhlldpssghpflsatmetahrytedfykcylekkrewlaktfyrpeqdentkrrisvff vpdgearkllplllirrrmkeqndlqdwirnkqahpidlpshlfdskimellkvkdgkkkw neafkdwwstkypdgmqpfyglrrelnihgksysyipsdgkkfadcythlmektvqdkkr elrtagkpvppdlaadikrsfhravnerefmlrlvqeddrlmlmainkmmtdreedilpg lknidsildeenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqyliliirnkaahnqfpcaaempliyrdvsakvgs iegssakdlpegsslvdslwkkyemiirkilpildpenrffgkllnnmsqpindl (SEQ ID NO: 559) |
| Porphyromonas gingivalis F0568 (AWUU01000145.1) >ERJ65637.1 | mntvpasenkgqsrtveddpqyfglylnlarenlieveshvrikfgkkklneeslkqsll cdhllsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkeallldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnprsmgfisvhdlrklllmellcegsfsrmqsdflrk anrildetaegklqfsalfpemrhrfippqnpkskdrrekaettlekyqkeikgrkdkln sqllsafdmdqrqlpsrlldewmnirpashsvklrtyvkqlnedcrlrlqkfrkdgdgka raiplvgematflsqdivrmiiseetkklitsayynemqrslaqyageenrhqfraivae lrlldpssghpflsatmetahrytedfykcylekkrewlaktfyrpeqdentkrrisvff vpdgearkllplllirrrmkeqndlqdwirnkqahpidlpshlfdskimellkvkdgkkkw neafkdwwstkypdgmqpfyglrrelnihgksysyipsdgkkfadcythlmektvqdkkr elrtagkpvppdlaadikrsfhravnerefmlrlvqeddrlmlmainkmmtdreedilpg lknidsildeenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqyliliirnkaahnqfpcaaempliyrdvsakvgs iegssakdlpegsslvdslwkkyemiirkilpildpenrffgkllnnmsqpindl (SEQ ID NO: 560) |
| Porphyromonas gingivalis W4087 (AWVE01000130.1) >ERJ87335.1 | mntvpasenkgqsrtveddpqyfglylnlarenlieveshvrikfgkkklneeslkqsll cdhllsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkeallldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnprsmgfisvhdlrklllmellcegsfsrmqsdflrk anrildetaegklqfsalfpemrhrfippqnpkskdrrekaettlekyqkeikgrkdkln sqllsafdmdqrqlpsrlldewmnirpashsvklrtyvkqlnedcrlrlqkfrkdgdgka raiplvgematflsqdivrmiiseetkklitsayynemqrslaqyageenrhqfraivae lrlldpssghpflsatmetahrytedfykcylekkrewlaktfyrpeqdentkrrisvff vpdgearkllplllirrrmkeqndlqdwirnkqahpidlpshlfdskvmellkvkdgkkkw neafkdwwstkypdgmqpfyglrrelnihgksysyipsdgkkfadcythlmektvrdkkr elrtagkpvppdlaayikrsfhravnerefmlrlvqeddrlmlmainkimtdreedilpg lknidsildkenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqyliliirnkaahnqfpcaaeipliyrdvsakvgs iegssakdlpegsslvdslwkkyemiirkilpildpenrffgkllnnmsqpindl (SEQ ID NO: 561) |
| Porphyromonas gingivalis W4087 (NZ_K1260263.1) >WP_021680012.1 | mntvpasenkgqsrtveddpqyfglylnlarenlieveshvrikfgkkklneeslkqsll cdhllsvdrwtkvyghsrrylpflhyfdpdsqiekdhdsktgvdpdsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkeallldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnprsmgfisvhdlrklllmellcegsfsrmqsdflrk anrildetaegklqfsalfpemrhrfippqnpkskdrrekaettlekyqkeikgrkdkln sqllsafdmdqrqlpsrlldewmnirpashsvklrtyvkqlnedcrlrlqkfrkdgdgka raiplvgematflsqdivrmiiseetkklitsayynemqrslaqyageenrhqfraivae lrlldpssghpflsatmetahrytedfykcylekkrewlaktfyrpeqdentkrrisvff vpdgearkllplllirrrmkeqndlqdwirnkqahpidlpshlfdskvmellkvkdgkkkw neafkdwwstkypdgmqpfyglrrelnihgksysyipsdgkkfadcythlmektvrdkkr elrtagkpvppdlaayikrsfhravnerefmlrlvqeddrlmlmainkimtdreedilpg lknidsildkenqfslavhakvlekegeggdnslslvpatieikskrkdwskyiryrydr |

TABLE 13-continued

| | |
|---|---|
| | rvpglmshfpehkatldevktllgeydrcrikifdwafalegaimsdrdlkpylhesssr egksgehstivkmlvekkgcltpdesqylilirnkaahnqfpcaaeipliyrdvsakvgs iegssakdlpegsslvdslwkkyemiirkilpildpenrffgkllnnmsqpindl (SEQ ID NO: 562) |
| *Porphyromonas gingivalis* F0568 (NZ_K1258981.1) >WP_021663197.1 | mntvpasenkgqsrtveddpqyfglylnlarenlieveshvrikfgkkklneeslkqsll cdhllsvdrwtkvyghsrrylpflhyfdpdsqiekdhdsktgvpdpsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkealldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnprsmgfisvhdlrklllmellcegsfsrmqsdflrk anrildetaegklqfsalfpemrhrfippqnpkskdrrekaettlekykqeikgrkdkln sqllsafdmdqrqlpsrlldewmnirpashsvklrtyvkqlnedcrlrlqkfrkdgdgka raiplvgematflsqdivrmiiseetkklitsayynemqrslaqyageenrhqfraivae lrlldpssghpflsatmetahrytedfykcylekkrewlaktfyrpeqdentkrrisvff vpdgearkllpllirrrmkeqndlqdwirnkqahpidlpshlfdskimellkvkdgkkkw neafkdwwstkypdgmqpfyglrrelnihgksysyipsdgkkfadcythlmektvqdkkr elrtagkpvppdlaadikrsfhravnerefmlrlvqeddrlmlmainkmmtdreedilpg lknidsildeenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqylilirnkaahnqfpcaaempliyrdvsakvgs iegssakdlpegsslvdslwkkyemiirkilpildpenrffgkllnnmsqpindl (SEQ ID NO: 563) |
| *Porphyromonas gingivalis* (NZ_LOEL01000010.1) >WP_061156637.1 | mntvpasenkgqsrtveddpqyfglylnlarenlieveshvrikfgkkklneeslkqsll cdhllsvdrwtkvyghsrrylpflhyfdpdsqiekdhdsktgvpdpsaqrlirelyslld flrndfshnrldgttfehlevspdissfitgtyslacgraqsrfadffkpddfvlaknrk eqlisvadgkecltvsglafficlfldreqasgmlsrirgfkrtdenwaravhetfcdlc irhphdrlessntkealldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnpqsmgfisvhdlrklllmellcegsfsrmqsdflrk anrildetaegklqfsalfpemrhrfippqnpkskdrrekaettlekykqeikgrkdkln sqllsafdmnqrqlpsrlldewmnirpashsvklrtyvkqlnedcrlrlrkfrkdgdgka raiplvgematflsqdivrmiiseetkklitsayynemqrslaqyageenrrqfraivae lhlldpssghpflsatmetahrytedfykcylekkrewlaktfyrpeqdentkrrisvff vpdgearkllpllirrrmkeqndlqdwirnkqahpidlpshlfdskimellkvkdgkkkw neafkdwwstkypdgmqpfyglrrelnihgksysyipsdgkkfadcythlmektvqdkkr elrtagkpvppdlaadikrsfhravnerefmlrlvqeddrlmlmainkmmtdreedilpg lknidsildekenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqylilirnkaahnqfpcaaempliyrdvsakvgs iegssakdlpegsslvdslwkkyemiirkilpildpenrffgkllnnmsqpindl (SEQ ID NO: 564) |
| *Porphyromonas gulae* (NZ_JRAQ01000019.1) >NV1_039445055.1 | mntvpatenkgqsrtveddpqyfglylnlarenlieveshvrikfgkkklneeslkqsll cdhllsidrwtkvyghsrrylpflhcfdpdsgiekdhdsktgvpdpsaqrlirelyslld flrndfshnrldgttfehlvspdissfitgaytfaceraqsrfadffkpddfvlaknrk eqlisvadgkecltvsgfafficlfldreqasgmlsrirgfkrtdenwaravhetfcdlc irhphdrlessntkealldmlnelnrcprilydmlpeeeraqflpaldensmnnlsens lneesrllwdgssdwaealtkrirhqdrfpylmlrfieemdllkgirfrvdlgeieldsy skkvgrngeydrtitdhalafgklsdfqneeevsrmisgeasypvrfslfapryaiydnk igychtsdpvypksktgekralsnpqsmgfisvhdlrklllmellcegsfsrmqsdflrk anrildetaegklqfsalfpemrhrfippqnpkskdrrekaettlekykqeikgrkdkln sqllsafdmnqrqlpsrlldewmnirpashsvklrtyvkqlnedcrlrlrkfrkdgdgka raiplvgematflsqdivrmiiseetkklitsayynemqrslaqyageenrrqfraivae lhlldpssghpflsatmetahrytedfykcylekkrewlaktfyrpeqdentkrrisvff vpdgearkllpllirrrmkeqndlqdwirnkqahpidlpshlfdskimellkvkdgkkkw neafkdwwstkypdgmqpfyglrrelnihgksysyipsdgkkfadcythlmektvrdkkr elrtagkpvppdlaayikrsfhravnerefmlrlvqeddrlmlmainkmmtdreedilpg lknidsildeenqfslavhakvlekegeggdnslslvpatieikskrkdwskyiryrydr rvpglmshfpehkatldevktllgeydrcrikifdwafalegaimsdrdlkpylhesssr egksgehstivkmlvekkgcltpdesqylilirnkaahnqfpcaaempliyrdvsakvgs iegssakdlpegsslvdslwkkyemiirkilpildhenrffgkllnnmsqpindl (SEQ ID NO: 565) |
| *Bacteroides pyogenes* F0041 (KE993153.1) >ER181700.1 | mesiknsqkstgktlqkdppyfglylnmallnvrkvenhirkwlgdvallpeksgfhsll ttdnlssakwtrfyyksrkflpflemfdsdkksyenrretteclatidrqkisslllkevy gklqdirnafshyhiddqsvkhtaliissemhrfienaysfalqktrarftgvfvetdfl qaeekgdnkkffaiggnegiklkdnaliflliclfldreeafkflsratgfkstkekgfla vretfcalccrqpherllsvnprealmdmlnelnrcpdilfemldekdqksfllpllgee eqahilenslndelceaiddpfemiaslskrvrykrnfpylmlryieeknllpfirfrid lgcelelasypkkmgeennyersvtdhamafgrltdfhnedavlqqitkgitdevrfslya pryaiynnkigfvrtggsdkisfptlkkkggeghcvaytlqntksfgfisiydlrkilll sfldkdkaknivsglleqcekhwkdlsenlfdairtelqkefpvpliryltlprskggklv sskladkqekyeseferrkekltellsekdfdlsqiprrmidewlnvlptsrekklkgyv etlkldcrerlrvfekrekgehpvpprigematdlakdiirmvidqgvkqritsayysei qrclaqyagddnrrhldsiirelrlkdtknghpflgkvlrpglghteklyqryfeekkew |

TABLE 13-continued

| | |
|---|---|
| | leatfypaaspkrvprfvnpptgkqkelpliirnlmkerpewrdwkqrknshpidlpsql<br>feneicrllkdkigkepsgklkwnemfklywdkefpngmqrfyrckrrvevfdkvveyey<br>seeggnykkyyealidevvrqkissskeksklqvedltlsvrrvfkrainekeyqlrllc<br>eddrllfmavrdlydwkeaqldldkidnmlgepvsysqviqleggqpdavikaecklkdv<br>sklmrycydgrvkglmpyfanheatqeqvemelrhyedhrrrvfnwvfaleksvlkneklrrfyeesqggcehrrcidalrkaslvseeeyeflvhirnksahnqfpdleigklppnvtsgfceciwskykaiicriipfidperrffgklleqk (SEQ ID NO: 566) |
| Bacteroides<br>pyogenes<br>JCM 10003<br>(NZ_BAIU01000001.1)<br>>WP_034542281.1 | mesiknsqkstgktlqkdppyfglylnmallnvrkvenhirkwlgdvallpeksgfhsll<br>ttdnlssakwtrfyyksrkflpflemfdsdkksyenrretaecldtidrqkissllkevy<br>gklqdirnafshyhiddqsvkhtaliissemhrfienaysfalqktrarftgvfvetdfl<br>qaeekgdnkkffaiggnegiklkdnaliflicllfldreeafkflsratgfkstkekgfla<br>vretfcalccrqpherllsvnpreallmdmlnelnrcpdilfemldekdqksflpllgee<br>eqahilenslndelceaiddpfemiaslskrvryknrfpylmlryieeknllpfirfrid<br>lgclelasypkkmgeennyersvtdhamafgrltdfhnedavlqqitkgitdevrfslya<br>pryaiynnkigfvrtsgsdkisfptlkkkggeghcvaytlqntksfgfisiydlrkilll<br>sfldkdkaknivsglleqcekhwkdlsenlfdairtelqkefpvplirytlprskggklv<br>ssklagkqekyeseferrkeklteilsekdfdlsqiprrmidewlnvlptsrekklkgyv<br>etlkldcrerlrvfekrekgehplpprigematdlakdiirmvidqgvkqritsayyseiqrclaqyagddnrrhldsiirelrlkdtknghpflgkvlrpglghteklyqryfeekkewleatfypaaspkrvprfvnpptgkqkelpliirnlmkerpewrdwkqrknshpidlpsql<br>feneicrllkdkigkepsgklkwnemfklywdkefpngmqrfyrckrrvevfdkvveyey<br>seeggnykkyyealidevvrqkissskeksklqvedltlsvrrvfkrainekeyqlrllc<br>eddrllfmavrdlydwkeaqldldkidnmlgepvsysqviqleggqpdavikaecklkdv<br>sklmrycydgrvkglmpyfanheatqeqvemelrhyedhrrrvfnwvfaleksvlkneklrrfyeesqggcehrrcidalrkaslvseeeyeflvhirnksahnqfpdleigklppnvtsgfceciwskykaiicriipfidperrffgklleqk (SEQ ID NO: 567) |
| Alistipes<br>sp. ZOR0009<br>(NZ_JTLD01000029.1)<br>>WP_047447901.1 | msneigafrehqfayapgnekqeeatfatyfnlalsnvegmmfgevesnpdkieksldtl<br>ppailrgiasfiwlskedhpdkaysteevkvivtdlvrrlcfyrnyfshcfyldtqyfys<br>delvdttaigeklpynfhhfitnrlfryslpeitlfrwnegerkyeilrdgliffcclfl<br>krgqaerflnelrffkrtdeegrikrttiftkyctreshkhigieeqdflifqdiigdlnr<br>vpkvcdgvvdlskeneryiknretsnesdenkaryrllirekdkfpyylmryivdfgvlp<br>citfkqndystkegrgqfhpadaavageercynfvvrngnvyysympqaqnvvriselqg<br>tisveelrnmvyasingkdvnksveqylyhlhllyekiltisgqtikegrvdvedyrpll<br>dklllrpasngeelrrelrkllpkrvcdllsnrfdcsegvsavekrlkaillrheqlllsqnpalhidkiksvidylylffsddekfrqqptekahrglkdeefqmyhylvgdydshplalwkeleasgrlkpemrkltsatslhglymlclkgtvewcrklghtlmssigkgtakveaiadryglklydklkeytpeqlerevklvvmhgyaaaatpkpkaqaaipskltelrfysflgkremsfaafirqdkkaqklwlrnfytveniktlqkrqaaadaacklynlvgevervhtndkvlvlvaqryrerllnvgskcavtldnperqqkladvyevqnawlsirfddldftlthvnlsnlrkaynlliprkhilafkeyldnrvkqklceecrnvrrkedlctccsprysnitswlkenhsessiereaatmmlldverkllsfllderrkaiieygkfipfsalvkecrladaglcgirndvlhdnvisyadaigklsayfpkeaseaveyirrtkevreqrreelmanssq (SEQ ID NO: 568) |
| Flavobacterium<br>branchiophilum<br>FL-15<br>(NC_016001.1)<br>>WP_014084666.1 | menlnkildkeneiciskifntkgiaapitekaldniksqkndlnkearlhyfsighsf<br>kqidtkkvfdyvlieeelkdekplkfitlqkdfftkefsiklqklinsirninnhyvhnfn<br>dinlnkidsnvfhflkesfelaiiekyyvknkkypldneivlflkelfikdentallnyf<br>tnlskdeaieyiltftitenkiwninnehnilniekgkyltfeamlflitiflykneanh<br>llpklydfknnkskqelftffskkftsqdidaeeghlikfrdmiqylnhyptawnndlkl<br>esenknkimttklidsiiefelnsnypsfatdiqfkkeakaflfasnkkrnqtsfsnksyneeirhnphikqyrdeiasaltpisfnvkedkfkifvkkhvleeyfpnsigyekfleyndftekekedfglklysnpktnklieridnhklvkshgrnqdrfmdfsmrflaennyfgkdaffkcykfydtqeqdeflqsnenndvkfhkgkvttyikyeehlknysywdcpfveennsm<br>svkisigseekilkiqrnlmiyflenalynenvenqgyklvnnyyrelkkdveesiasldliksnpdfkskykkilprllhnyapakqdkapenafetllkkadfreeqykkllkkaehe<br>knkedfvkrnkgkqfklhfirkacqmmyfkekyntlkegnaafekkdpviekrknkehefghhknlnitreefndyckwmfafngndsykkylrdlfsekhffdnqeyknlfessvnleafyaktkelfkkwietnkptnnenrytlenyknlilqkqvfinvyhfskylidknllnse<br>nnviqykslenveylisdfyfqsklsidqyktcgklfnklksnkledcllyeiaynyidkknvhkidigkiltskiiltindantpykisvpfnkklerytemiaiknqnnlkarflidlp<br>lylsknkikkgkdsagyeiiikndleiedintinnkiindsvkftevlmelekyfilkdkcilsknyidnseipslkqfskvwikeneneiinyrniachfhlplletfdnlllnveqkfikeelqnvstindlskpqeylilllfikfkhnnfylnlfnknesktikndkevkknrvlqkfinqvilkkk (SEQ ID NO: 569) |
| Prevotella<br>sp. MA2016<br>(NZ_JHUW01000010.1)<br>>WP_036929175.1 | mskeckkgrqekkrrlqkanfsisltgkhvfgayfnmartnfvktinyilpiagvrgnys<br>enqinkmlhalfligagrneelttteqkqwekklrinpeqqtkfqkllfkhfpvlgpmmad<br>vadhkaylnkkkstvqtedetfamlkgvsladcldiiclmadtltecrnfythkdpynkp<br>sqladqylhqemiakkldkvvvasrrilkdreglsvnevefltgidhlhqevlkdefgnakvkdgkvmktfveyddfyfkisgkrlvngytvttkddkpvnvntmlpalsdfgllyfcvlflskpyaklfidevrlfeyspfddkenmimsemlsiyrirtprlhkidshdskatlamdifgelrrcpmelynlldknagqpffhdevkhpnshtpdvskrlryddrfptlalryidete<br>lfkrirfqlqlgsfrykfydkencidgrvrvrriqkeingygrmqevadkrmdkwgdliq<br>kreersvkleheelyinldqfledtadstpyvtdrrpaynihanriglywedsqnpkqykvfdengmyipelvvtedkkapikmpaprcalsvydlpamlfyeylreqqdnefpsaeqviieyeddyrkffkavaegklkpfkrpkefrdflkkeypklrmadipkklqlflcshglcynnkpetvyerldrltlqhleerelhiqnrleyhqkdrdmignkdnqygkksfsdvrhgalarylaqsmmewqptklkdkekghdkltglnynvltaylatyghpvpeegftprtleqvli |

TABLE 13-continued

| | |
|---|---|
| | nahliggsnphpfinkvlalgnrnieelylhyleeelkhirsriqslssnpsdkalsalp fihhdrmryhertseemmalaaryttiqlpdglftpyileilqkhytensdlqnalsqdv pvklnptcnaaylitlfyqtvlkdnaqpfylsdktytrnkdgekaesfsfkrayelfsvl nnnkkdtfpfemiplfltsdeigerlsaklldgdgnpvpevgekgkpatdsqgntiwkrr iysevddyaekltdrdmkisfkgeweklprwkqdkiikrrdetrrqomrdellqrmpryir dikdnertlrryktqdmvlflllaekmftniiseqssefnwkqmrlskvcneaflrqtltf rvpvtvgettiyvegenmslknygefyrfltddrlmsllnnivetlkpnengdlvirhtd lmselaaydqyrstifmliqsienliitnnavlddpdadgfwvredlpkrnnfaslleli nqlnnveltdderkllvairnafshnsynidfslikdvkhlpevakgilqhlqsmlgvei tk (SEQ ID NO: 570) |
| *Myroides odomtimimus* CCUG 10230 (AGEC02000017.1) >EHO06562.1 | mkdilttedttekqnrfyshkiadkyffggyfnlasnniyevfeevnkrntfgklakrdng nlknyiihvfkdelsisdfekrvaifasyfpiletvdkksikernrtidltlsgrirqfr emlislvtavdqlrnfythyhhsdivienkvldflnssfvstalhvkdkylktdktkefl ketiaaeldilieaykkkqiekkntrfkankredilnaiyneafwsfindkdkdkdketv vakgadayfeknhhksndpdfalnisekgivyllsffltnkemdslkanitgfkgkvdre sgnsikymatqrlysfhtyrglkqkirtseegvketllmqmidelskvpnvvyqhlsttq qnsfiedwneyykdyeddvetddlsrvihpvirkryedrfnyfairfldeffdfptlrfq vhlgdyvhdrrtkqlgkvesdriikekvtvfarlkdinsakasyfhsleeqdkeeldnkw tlfpnpsydfpkehtlqhqgeqknagkigiyvklrdtqykekaaleearkslnpkersat kaskydiitqiieandnvksekplvftgqpiaylsmndihsmlfslltdnaelkktpeev eaklidgigkqineilskdtdtkilkkykdndlketdtdkitrdlardkeeiekliIeqk qraddynytsstkfnidksrkrkhllfnaekgkigvwlandikrfmfkeskskwkgyqht elqklfayfdtsksdleliIsnmvmvkdypielidlvkksrtivdflnkylearleyien vitrvknsigtpqfktvrkecftflkksnytvvsldkqverilsmplfiergfmddkptm legksykqhkekfadwfvhykensnyqnfydtevyeittedkrekakvtkkikqqqkndv ftlmmvnymleevlklssndrlslnelyqtkeerivnkqvakdtgernknyiwnkvvdlq lcdglvhidnvklkdignfrkyendsrvkefltyqsdivwsaylsnevdsnklyvierql dnyesirskellkevqeiecsvyqnqvankeslkqsgnenfkqyvlqglIpigmdvremli lstdvkfkkeeiiqlgqagevecqdlysliyirnkfahnqlpikeffdfcennyrsisdne yyaeyymeifrsikekyan (SEQ ID NO: 571) |
| *Myroides odomtimimus* CCUG 3837 (AGEC01000016.1) >EKB06014.1 | mkdilttedttekqnrfyshkiadkyffggyfnlasnniyevfeevnkrntfgklakrdng nlknyiihvfkdelsisdfekrvaifasyfpiletvdkksikernrtidltlsgrirqfr emlislvtavdqlrnfythyhhseivienkvldflnsslvstalhvkdkylktdktkefl ketiaaeldilieaykkkqiekkntrfkankredilnaiyneafwsfindkdkdketvva kgadayfeknhhksndpdfalnisekgivyllsffltnkemdslkanitgfkgkvdresg nsikymatqrlysfhtyrglkqkirtseegvketllmqmidelskvpnvvyqhlsttqqn sfiedwneyykdyeddvetddlsrvihpvirkryedrfnyfairfldeffdfptlrfqvh lgdyvhdrrtkqlgkvesdriikekvtvfarlkdinsakasyfhsleeqdkeeldnkwtl fpnpsydfpkehtlqhqgeqknagkigiyvklrdtqykekaaleearkslnpkersatka skydiitqiieandnvksekplvftgqpiaylsmndihsmlfslltdnaelkktpeevea klidgigkqineilskdtdtkilkkykdndlketdtdkitrdlardkeeiekliIeqkqr addynytsstkfnidksrkrkhllfnaekgkigvwlandikrfmfkeskskwkgyqhtel qklfayfdtsksdleliIsdmvmvkdypielidlvrksrtivdflnkylearlgyienvi trvknsigtpqfktvrkecfafllkesnytvasldkqierilsmplfiergfmdskptmle gksyqqhkedfadwfvhykensnyqnfydtevyeiitedkreqakvtkkikqqqkndvft lmmvnymleevlklpsndrlslnelyqtkeerivnkqvakdtgernknyiwnkvvdlqlc eglvridkvklkdignfrkyendsrvkefltyqsdivwsgylsnevdsnklyvierqldn yesirskellkevqeiecivynqvankeslkqsgnenfkqyvlqgllprgtdvremlils tdvkfkkeeimqlgqvreveqdlysliyirnkfahnqlpikeffdfcennyrpisdneyy aeyymeifrsikekyas (SEQ ID NO: 572) |
| *Myroides odomtimimus* CCUG 3837 (NZ_111815535 1) >WP_006265509.1 | mkdilttedttekqnrfyshkiadkyffggyfnlasnniyevfeevnkrntfgklakrdng nlknyiihvfkdelsisdfekrvaifasyfpiletvdkksikernrtidltlsgrirqfr emlislvtavdqlrnfythyhhseivienkvldflnsslvstalhvkdkylktdktkefl ketiaaeldilieaykkkqiekkntrfkankredilnaiyneafwsfindkdkdketvva kgadayfeknhhksndpdfalnisekgivyllsffltnkemdslkanitgfkgkvdresg nsikymatqrlysfhtyrglkqkirtseegvketllmqmidelskvpnvvyqhlsttqqn sfiedwneyykdyeddvetddlsrvihpvirkryedrfnyfairfldeffdfptlrfqvh lgdyvhdrrtkqlgkvesdriikekvtvfarlkdinsakasyfhsleeqdkeeldnkwtl fpnpsydfpkehtlqhqgeqknagkigiyvklrdtqykekaaleearkslnpkersatka skydiitqiieandnvksekplvftgqpiaylsmndihsmlfslltdnaelkktpeevea klidgigkqineilskdtdtkilkkykdndlketdtdkitrdlardkeeiekliIeqkqr addynytsstkfnidksrkrkhllfnaekgkigvwlandikrfmfkeskskwkgyqhtel qklfayfdtsksdleliIsdmvmvkdypielidlvrksrtivdflnkylearlgyienvi trvknsigtpqfktvrkecfafllkesnytvasldkqierilsmplfiergfmdskptmle gksyqqhkedfadwfvhykensnyqnfydtevyeiitedkreqakvtkkikqqqkndvft lmmvnymleevlklpsndrlslnelyqtkeerivnkqvakdtgernknyiwnkvvdlqlc eglvridkvklkdignfrkyendsrvkefltyqsdivwsgylsnevdsnklyvierqldn yesirskellkevqeiecivynqvankeslkqsgnenfkqyvlqgllprgtdvremlils tdvkfkkeeimqlgqvreveqdlysliyirnkfahnqlpikeffdfcennyrpisdneyy aeyymeifrsikekyas (SEQ ID NO: 573) |
| *Myroides odomtimimus* CCUG 12901 (NZ_H-1590834.1) >WP_006261414.1 | mkdilttedttekqnrfyshkiadkyffggyfnlasnniyevfeevnkrntfgklakrdng nlknyiihvfkdelsisdfekrvaifasyfpiletvdkksikernrtidltlsgrirqfr emlislvtavdqlrnfythyhhseivienkvldflnsslvstalhvkdkylktdktkefl ketiaaeldilieaykkkqiekkntrfkankredilnaiyneafwsfindkdkdketvva kgadayfeknhhksndpdfalnisekgivyllsffltnkemdslkanitgfkgkvdresg nsikymatqrlysfhtyrglkqkirtseegvketllmqmidelskvpnvvyqhlsttqqn |

TABLE 13-continued

|  |  |
|---|---|
| | sfiedwneyykdyeddvetddlsrvihpvirkryedrfnyfairfldeffdfptlrfqvh<br>lgdyvhdrrtkqlgkvesdriikekvtvfarlkdinsakanyfhsleeqdkeeldnkwtl<br>fpnpsydfpkehtlqhqgeqknagkigiyvklrdtqykekaaleeearkslnpkersatka<br>skydiitqiieeandnvksekplvftgqpiaylsmndihsmlfslltdnaelkktpeevea<br>klidgigkqineilskdtdtkilkkykdndlketdtdkitrdlardkeeieklileqkqr<br>addynytsstkfnidksrkrkhllfnaekgkigvwlandikrfmteefkskwkgyqhtel<br>qklfayydtsksdldlilsdmvmvkdypielialvkksrtivdflnkylearlgymenvi<br>trvknsigtpqfktvrkecftflkksnytvvsldkqverilsmplfiergfmddkptmle<br>gksyqqhkekfadwfvhykensnyqnfydtevyeittedkrekakvtkkikqqqkndvft<br>lmmvnymleevlklssndrlslnelyqtkeerivnkqvakdtgernknyiwnkvvdlqlc<br>eglvridkvklkdignfrkyendsrvkefltyqsdivwsaylsnevdsnklyvierqldn<br>yesirskellkevqeiecsvynqvankeslkqsgnenfkqyvlqglvpigmdvremlils<br>tdvkfikeeiiqlgqageveqdlysliyirnkfahnqlpikeffdfcennyrsisdneyy<br>aeyymeifrsikekyts (SEQ ID NO: 574) |
| *Myroides<br>odomtimimus*<br>CCUG 12901<br>(AGED01000033.1)<br>>EHO08761.1 | mkdilttdttekqnrfyshkiadkyffggyfnlasnniyevfeevnkrntfgklakrdng<br>nlknyiihvfkdelsisdfekrvaifasyfpiletvdkksikernrtidltlsgrirqfr<br>emlislvtavdqlrnfythyhhseivienkvldflnsslvstalhvkdkylktdktkefl<br>ketiaaeldilieaykkkqieknktrfkankrediilnaiyneafwsfindkdkdketvva<br>kgadayfeknhhksndpdfalnisekgivyllsffltnkemdslkanitgfkgkvdresg<br>nsikymatqrlysfhtyrglkqkirtseegvketllmqmidelskvpnvvyqhlsttqqn<br>sfiedwneyykdyeddvetddlsrvihpvirkryedrfnyfairfldeffdfptlrfqvh<br>lgdyvhdrrtkqlgkvesdriikekvtvfarlkdinsakanyfhsleeqdkeeldnkwtl<br>fpnpsydfpkehtlqhqgeqknagkigiyvklrdtqykekaaleeearkslnpkersatka<br>skydiitqiieeandnvksekplvftgqpiaylsmndihsmlfslltdnaelkktpeevea<br>klidgigkqineilskdtdtkilkkykdndlketdtdkitrdlardkeeieklileqkqr<br>addynytsstkfnidksrkrkhllfnaekgkigvwlandikrfmteefkskwkgyqhtel<br>qklfayydtsksdldlilsdmvmvkdypielialvkksrtivdflnkylearlgymenvi<br>trvknsigtpqfktvrkecftflkksnytvvsldkqverilsmplfiergfmddkptmle<br>gksyqqhkekfadwfvhykensnyqnfydtevyeittedkrekakvtkkikqqqkndvft<br>lmmvnymleevlklssndrlslnelyqtkeerivnkqvakdtgernknyiwnkvvdlqlc<br>eglvridkvklkdignfrkyendsrvkefltyqsdivwsaylsnevdsnklyvierqldn<br>yesirskellkevqeiecsvynqvankeslkqsgnenfkqyvlqglvpigmdvremlils<br>tdvkfikeeiiqlgqageveqdlysliyirnkfahnqlpikeffdfcennyrsisdneyy<br>aeyymeifrsikekyts (SEQ ID NO: 575) |
| *Myroides<br>odomtimimus*<br>(NZ_CP013690.1)<br>>WP_058700060.1 | mkdilttdttekqnrfyshkiadkyffggyfnlasnniyevfeevnkrntfgklakrdng<br>nlknyiihvfkdelsisdfekrvaifasyfpiletvdkksikernrtidltlsgrirqfr<br>emlislvtavdqlrnfythyhhsdivienkvldflnssfvstalhvkdkylktdktkefl<br>ketiaaeldilieaykkkqieknktrfkankrediilnaiyneafwsfindkdkdketv<br>vakgadayfeknhhksndpdfalnisekgivyllsffltnkemdslkanitgfkgkvdre<br>sgnsikymatqrlysfhtyrglkqkirtseegvketllmqmidelskvpnvvyqhlsttq<br>qnsfiedwneyykdyeddvetddlsrvthpvirkryedrfnyfairfldeffdfptlrfq<br>vhlgdyvhdrrtkqlgkvesdriikekvtvfarlkdinsakasyfhsleeqdkeeldnkw<br>tlfpnpsydfpkehtlqhqgeqknagkigiyvklrdtqykekaaleeearkslnpkersat<br>kaskydiitqiieeandnvksekplvftgqpiaylsmndihsmlfslltdnaelkktpeev<br>eaklidgigkqineilskdtdtkilkkykdndlketdtdkitrdlardkeeieklileqk<br>qraddynytsstkfnidksrkrkhllfnaekgkigvwlandikrfmfkeskskwkgyqhi<br>elqklfayfdtsksdlelilsnmvmvkdypielidlvkksrtivdflnkylearleyien<br>vitrvknsigtpqfktvrkecftflkksnytvvsldkqverilsmplfiergfmddkptm<br>legksykqhkekfadwfvhykensnyqnfydtevyeittedkrekakvtkkikqqqkndv<br>ftlmmvnymleevlklssndrlslnelyqtkeerivnkqvakdtgernknyiwnkvvdlq<br>lcdglvhidnvklkdignfrkyendsrvkefltyqsdivwsaylsnevdsnklyvierql<br>dnyesirskellkevqeiecsvynqvankeslkqsgnenfkqyvlqgllpigmdvremli<br>lstdvkfkkeeiiqlgqageveqdlysliyirnkfahnqlpikeffdfcennyrsisdne<br>yyaeyymeifrsikekyan (SEQ ID NO: 576) |
| *Bergeyella<br>zoohelcum*<br>ATCC 43767<br>(AGYA01000037.1)<br>>EKB54193.1 | menktslgnniyynpfkpqdksyfagyfnaamentdsvfrelgkrlkgkeytsenffdai<br>fkenislveyeryvkllsdyfpmarlldkkevpikerkenfkknfkgiikavrdlrnfyt<br>hkehgeveitdeifgvldemlkstvltvkkkkvktdktkeilkksiekqldilcqkkley<br>lrdtarkieekrrnqrergekelvapfkysdkrddliaaiyndafdvyidkkkdslkess<br>kakyntksdpqqeegdlkipiskngvvfllslfltkqeihafkskiagfkatvideatvs<br>eatvshgknsicfmatheifshlaykkllkrkvrtaeinygeaenaeqlsvyaketlmmqm<br>ldelskvpdvvyqnlsedvqktfiedwneylkenngdvgtmeeeqvihpvirkryedkfn<br>yfairfldefaqfptlrfqvhlgnylhdsrpkenlisdrrikekitvfgrlselehkkal<br>fikntetnedrehyweifpnpnydfpkenisvndkdfpiagsildrekqpvagkigikvk<br>llnqqyvsevdkavkahqlkqrkaskpsigniieeivpinesnpkeaivfgggptaylsm<br>ndihsilyeffdkwekkkeklekkgekelrkeigkelekkivgkiqaqiqqiidkdtnak<br>ilkpyqdgnstaidkeklikdlkqeqnilqklkdeqtvrekeyndfiayqdknreinkvr<br>drnhkqylkdnlrkrypeaparkevlyyrekgkvavwlandikrfmptdfknewkgeqhs<br>llqkslayyeqckeelknllpekvfqhlpfklggyfqqkylyqfytcyldkrleyisglv<br>qqaenfksenkvfkkvenecfkflkkqnythkeldarvqsilgypiflergfmdekptii<br>kgktfkgnealfadwfryykeyqnfqtfydtenyplvelekkqadrkrktkiyqqkndv<br>ftllmakhifksvfkqdsidqfsledlyqsreerlgngerarqtgerntnyiwnktvdlk<br>lcdgkitvenvklknvgdfikyeydqrvqaflkyeeniewqaflikeskeeenypyvver<br>eiegyekvrreellkevhlieeyilekvkdkeilkkgdnqnfkyyilngllkqlknedve<br>sykvfnlntepedvninqlkqeatdlegkafvltyirnkfahnqlpkkefwdycqekygk<br>iekektyaeyfaevfkkekealik (SEQ ID NO: 577) |

TABLE 13-continued

| | |
|---|---|
| *Capnocytophaga cynodegmi* (NZ_CD0D01000002.1) >WP_041989581.1 | menktslgnniiyynpfkpqdksyfagylnaamenidsvfrelgkrlkgkeytsenffdai fkenislveyeryvkllsdyfpmarlldkkevpikerkenfkknfrgiikavrdlrnfyt hkehgeveitdeifgvldemlkstvltvkkkkiktdktkeilkksiekqldilcqkkley lkdtarkieeekrrnqrergekklvprfeysdrrddliaaiyndafdvyidkkkdslkess ktkyntesypqqeegdlkipiskngvvfllslflskqevhafkskiagfkatvideatvs hrknsicfmatheifshlaykkklkrkvrtaeinyseaenaeqlsiyaketlmmqmldels kvpdvvyqnlsedvqktfiedwneylkenngdvgtmeeeqvihpvirkryedkfnyfair fldefaqfptlrfqvhlgnylhdsrpkehlisdrrikekitvfgrlselehkkalfiknt etnedrkhywevfpnpnydfpkenisvndkdfpiagsildrekqptagkigikvnllnqk yisevdkavkahqlkqrnnkpsigniieeeivpingsnpkeiivfggqptaylsmndihsi lyeffdkwekkkeklekkgekelrkeigkeleekivgkiqtqiqqiidkdinakilkpyq dddstaidkeklikdlkqeqkilqklkneqtarekeyqeciayqeesrkikrsdksrqky lrnqlkrkypevptrkeilyyqekgkvavwlandikrfmptdfknewkgeqhsllqksla yyeqckeelknllpqqkvfkhlpfelgghfqqkylyqfytryldkrlehisglvqqaenf knenkvfkkvenecfkflkkqnythkgldaqaqsvlgypiflergfmdekptiikgktfk gneslftdwfryykeyqnfqtfydtenyplvelekkqadrkretkiyqqkkndvftllma khifksvfkqdsidrfsledlyqsreerlengekakqtgerntnyiwnktvdlnlcdgkv tvenvklknvgnfikyeydqrvqtflkyeenikwqaflikeskeeenypyivereieqye kvrreellkevhlieeyilekvkdkeilkkgdnqnfkyyilngllkqlknedvesykvfn lntkpedvninqlkqeatdleqkafvltyirnkfahnqlpkkefwdycqekygkiekekt yaeyfaevfkrekealmk (SEQ ID NO: 578) |
| *Bergeyella zoohelcum* ATCC 43767 (NZ_JH932293.1) >WP_002664492.1 | menktslgnniiyynpfkpqdksyfagyfnaamentdsvfrelgkrlkgkeytsenffdai fkenislveyeryvkllsdyfpmarlldkkevpikerkenfkknfkgiikavrdlrnfyt hkehgeveitdeifgvldemlkstvltvkkkkvktdktkeilkksiekqldilcqkkley lrdtarkieeekrrnqrergekelvapfkysdkrddliaaiyndafdvyidkkkdslkess kakyntksdpqqeegdlkipiskngvvfllslfltkqeihafkskiagfkatvideatvs eatvshgknsicfmatheifshlaykkklkrkvrtaeinygeaenaeqlsvyaketlmmqm ldelskvpdvvyqnlsedvqktfiedwneylkenngdvgtmeeeqvihpvirkryedkfn yfairfldefaqfptlrfqvhlgnylhdsrpkenlisdrrikekitvfgrlselehkkal fikntetnedrehyweifpnpnydfpkenisvndkdfpiagsildrekqpvagkigikvk llnqqyvsevdkavkahqlkqrkaskpsigniieeeivpinesnpkeaivfggqptaylsm ndihsilyeffdkwekkkeklekkgekelrkeigkelekkivgkiqaqiqqiidkdtnak ilkpyqdgnstaidkeklikdlkqeqnilqklkdeqtvrekeyndfiayqdknreinkvr drnhkqylkdnlkrkypeaparkevlyyrekgkvavwlandikrfmptdfknewkgeqhs llqkslayyeqckeelknllpekvfqhlpfklggyfqqkylyqfytcyldkrleyisglv qqaenfksenkvfkkvenecfkflkkqnythkeldarvqsilgypiflergfmdekptii kgktfkgnealfadwfryykeyqnfqtfydtenyplvelekkqadrkrktkiyqqkkndv ftllmakhifksvfkqdsidqfsledlyqsreerlgngerarqtgerntnyiwnktvdlk lcdgkitvenvklknvgdfikyeydqrvqaflkyeeniewqaflikeskeeenypyvver eiegyekvrreellkevhlieeyilekvkdkeilkkgdnqnfkyyilngllkqlknedve sykvfnlntepedvninqlkqeatdlegkafvltyirnkfahnqlpkkefwdycqekygk iekektyaeyfaevfkkekealik (SEQ ID NO: 579) |
| *Flavobacterium* sp. 316 (NZ_JYGZ01000003.1) >NV_P045968377.1 | mdnnitvektelglgitynhdkvedkhyfggffnlaqnnidlvagefkkrlliqgkdsin ifanyfsdqcsitnlergikilaeyfpvvsyidldeknksksirehllilletinnlrny ythyyhkkiiidgslfplldtillkvvleikkkklkedktkqllkkglekemtilfnlmk aegkekkikgwnidenikgavinrafshllyndelsdyrkskyntedetlkdtltesgil fllsfflnkkeqeqlkanikgykgkiasipdeeitlknnslrnmathwtyshltykglkh riktdheketllvnmvdylskvpheiyqnlseqnkslfledineymrdneenhdsseasr vihpvirkryenkfayfairfldefaefptlrfmvnvgnyihdnrkkdiggtslitnrti kqqinvfgniteihkkkndyfekeenkektlewelfpnpsyhfqkenipifidleksket ndlakeyakekkkifgssrkkqqntakknretiinlvfdkyktsdrktvtfeqptallsf nelnsflyaflvenktgkelekiiiekianqyqilkncsstvdktndnipksikkivntt tdsfyfegkkidieklekditieiektnekletikeneesagnykrnerntqkrklyrky vfftneigieatwitndilrfldnkenwkgyqhselqkfisqydnykkealglleseewnl esdaffgqnlkrmfqsnstfetfykkyldnrkntletylsaienlktmtdvrpkvlkkw telfrffdkkiyllstietkinelitkpinlsrgifeekptfingknpnkennqhlfanw fiyakkqtilqdfynlpleqpkaitnlkkhkyklersinnlkiediyikqmvdflyqklf eqsfigslqdlytskekreiekgkakneqtpdesfiwkkgveinthngriiaktkikdig kfknlltdnkiahlisyddriwdfslnndgditkklysintelesyetirrekllkqiqq feqfllegeteysaerkhpekfekdcnpnfkkyiiegvinkiipnheieeieilkskedv fkinfsdililnndnikkgyllimirnkfahnglidknlfnfslqlysknenenfseyln kvcqniiqefkekelk (SEQ ID NO: 580) |
| *Psychroflexus torquis* ATCC 700755 (NC_018721.1) >WP_015024765.1 | mesiiglglsfnpyktadkhyfgsflnlvennlnavfaefkerisykakdenissliekh fidnmsivdyekkisilngylpiidflddelennlntrvknfkknfiilaeaieklrdyy thfyhdpitfednkepllelldevllktildvkkkylktdktkeilkdslreemdllvir ktdelrekkktnpkightdsssqiknsifndafqgllyedkgnnkktqvshraktrinpkd ihkqeerdfeiplststglvflmslflskkeiedfksnikgfkgkvvkdenhnslkymath rvysilafkglkyriktdtfsketlmmqmidelskvpdcvyqnlsetkqkdfiedwneyf kdneeentenlensrvvhpvirkryedkfnyfairfldefanfktlkfqvfmgyyihdqrt ktigttnittertvkekinvfgklskmdnlkkhffsqlsddentdweffpnpsynfltqa dnspannipiylelknqqiikekdaikaevnqtqnrnpnkpskrdllnkilkltyedfhqg dptailslneipallhlflvkpnnktgqienirikiekqfkainhpsknnkgipkslf adtnvrvnaiklkkdleaeldmlnkkhiafkenqkassnydkllkehqftpknkrpelrk yvfyksekgeeatwlandikrfmpkdfktkwkgcqhselqrklafydrhtkqdikellsg cefdhslldinayfqkdnfedffskylenrietlegvlkklhdfkneptplkgvfkncfk flkrqnyvtespeiikkrilakptflprgvfderptmkkgknplkdknefaewfveylen |

TABLE 13-continued

| | |
|---|---|
| | kdyqkfynaeeyrmrdadfkknavikkqklkdfytlqmvnyllkevfgkdemnlqlself<br>qtrgerlklqgiakkqmnketgdssentrnqtyiwnkdvpvsffngkvtidkvklknigk<br>ykryerdervktfigyevdekwmmylphnwkdrysvkpinvidlqiqeyeeirshellke<br>iqnlegyiydhttdkinillqdgnpnfkmyvinglligikqvnipdfivlkqntnfdkidf<br>tgiasscselekktiiliairnkfahnqlpnkmiydlaneflkieknetyanyylkvlkkm<br>isdla (SEQ ID NO: 581) |
| *Flavobacterium columnare* ATCC 49512 (NC_016510.2) >WP_014165541.1 | mssknesynkqktfnhykqedkyffggflnnaddnlrqvgkefktrinfnhnnnelasvf<br>kdyfnkeksvakrehalnllsnyfpvleriqkhtnhnfeqtreifellldtikklrdyyt<br>hhyhkpitinpkiydflddtlldvlitikkkkvkndtsrellkeklrpeltqlknqkree<br>likkgkklleenlenavfnhclrpfleenktddkqnktvslrkyrkskpneetsitltqs<br>glvflmsfflhrkefqvftsglegfkakvntikeeeislnknnivymithwsysyynfkg<br>lkhriktdqgvstleqnntthsltntntkealltqivdylskvpneiyetlsekqqkefe<br>edineymrenpenedstfssivshkvirkryenkfnyfamrfldeyaelptlrfmvnfgd<br>yikdrqkkilesiqfdseriikkeihlfeklslvteykknvylketsnidlsrfplfpnp<br>syvmannnipfyidsrsnnldeylnqkkkaqsqnkrnitfekynkeqskdaiiamlqke<br>igvkdlqqrstigllscnelpsmlyevivkdikgaelenkiaqkireqyqsirdftldsp<br>qkdnipttliktintdssvtfenqpidiprlknaigkeltltqekllnvkeheievdnyn<br>rnkntykfknqpknkvddkklqrkyvfyrneirgeanwlasdlihfmknkslwkgymhne<br>lqsflaffedkkndcialletvfnlkedciltkglknlflkhgnfidfykeylklkedfl<br>ntestflengligglppkilkkelskrfkyifivfqkrqfiikeleeekknnlyadainlsr<br>gifdekptmipfkknpndefaswfvasyqynnyqsfyeltpdiverdkkkkyknlraink<br>vkiqdyylklmvdtlyqdlfnqpldkslsdfyvskaerekikadakayqkrndsslwnkv<br>ihlslqnnritanplkdigkykralqdekiatlltyddrtwtyalqkpekenendykel<br>hytalnmelqeyekvrskellkqvqelekqileeytdflstqihpadferegnpnfkkyl<br>ahsilenddldklpekveamreldetitnpiikkaivliiirnkmahnqyppkfiydla<br>nrfvpkkeeeyfatyfnrvfetitkelwenkekkdktqv (SEQ ID NO: 582) |
| *Flavobacterium columnare* (NZ_CP013992.1) >WP_060381855.1 | mssknesynkqktfnhykqedkyffggflnnaddnlrqvgkefktrinfnhnnnelasvf<br>kdyfnkeksvakrehalnllsnyfpvleriqkhtnhnfeqtreifellldtikklrdyyt<br>hhyhkpitinpkvydflddtlldvlitikkkkvkndtsrellkekfrpeltqlknqkree<br>likkgkklleenlenavfnhclrpfleenktddkqnktvslrkyrkskpneetsitltqs<br>glvflisfflhrkefqvftsglegfkakvntikeeeislnknnivymithwsysyynfkg<br>lkhriktdqgvstleqnntthsltntntkealltqivdylskvpneiyetlsekqqkefe<br>edineymrenpenedstfssivshkvirkryenkfnyfamrfldeyaelptlrfmvnfgd<br>yikdrqkkilesiqfdseriikkeihlfeklglvteykknvylketsnidlsrfplfpsp<br>syvmannnipfyidsrsnnldeylnqkkkaqsqnrkrnitfekynkeqskdaiiamlqke<br>igvkdlqqrstigllscnelpsmlyevivkdikgaelenkiaqkireqyqsirdftldsp<br>qkdnipttltktistdtsvtfenqpidiprlknalqkeltltqekllnvkqheievdnyn<br>rnkntykfknqpkdkvddnklqrkyvfyrneiggeanwlasdlihfmknkslwkgymhne<br>lqsflaffedkkndcialletvfnlkedciltkdlknlflkhgnfidfykeylklkedfl<br>ntestflengfiglppkilkkelskrinyifivfqkrqfiikeleeekknnlyadainlsr<br>gifdekptmipfkknpndefaswfvasyqynnyqsfyeltpdkiendkkkkyknlraink<br>vkiqdyylklmvdtlyqdlfnqpldkslsdfyvsktdrekikadakayqkrndsflwnkv<br>ihlslqnnritanplkdigkykralqdekiatlltyddrtwtyalqkpekenendykel<br>hytalnmelqeyekvrskkllkqvqelekqildkfydfsnnathpedleiedkkgkrhpn<br>fklyitkallkneseiinlenidieilikyydynteklkekiknmdedekakivntkeny<br>nkitnvlikkalvliiirnkmahnqyppkfiydlatrfvpkkeeeyfacyfnrvfetitt<br>elwenkkkakeiv (SEQ ID NO: 583) |
| *Flavobacterium columnare* (NZ_CP015107.1) >WP_063744070.1 | mssknesynkqktfnhykqedkyffggflnnaddnlrqvgkefktrinfnhnnnelasvf<br>kdyfnkeksvakrehalnllsnyfpvleriqkhtnhnfeqtreifellldtikklrdyyt<br>hhyhkpitinpkiydflddtlldvlitikkkkvkndtsrellkeklrpeltqlknqkree<br>likkgkklleenlenavfnhclrpfleenktddkqnktvslrkyrkskpneetsitltqs<br>glvflmsfflhrkefqvftsglegfkakvntikeekislnknnivymithwsysyynfkg<br>lkhriktdqgvstleqnntthsltntntkealltqivdylskvpneiyetlsekqqkefe<br>edineymrenpenedstfssivshkvirkryenkfnyfamrfldeyaelptlrfmvnfgd<br>yikdrqkkilesiqfdseriikkeihlfeklglvteykknvylketsnidlsrfplfpsp<br>syvmannnipfyidsrsnnldeylnqkkkaqsqnrkrnitfekynkeqskdaiiamlqke<br>igvkdlqqrstigllscnelpsmlyevivkdikgaelenkiaqkireqyqsirdftlnsp<br>qkdnipttliktistdtsvtfenqpidiprlknaigkelaltqekllnvkqheievnnyn<br>rnkntykfknqpkdkvddnklqrkyvfyrneiggeanwlasdlihfmknkslwkgymhne<br>lqsflaffedkkndcialletvfnlkedciltkdlknlflkhgnfidfykeylklkedfl<br>ntestflengfiglppkilkkelskrinyifivfqkrqfiikeleeekknnlyadainlsr<br>gifdekptmipfkknpndefaswfvasyqynnyqsfyeltpdkiendkkkkyknlraink<br>vkiqdyylklmvdtlyqdlfnqpldkslsdfyvsktdrekikadakayqkrndsflwnkv<br>ihlslqnnritanplkdigkykralqdekiatlltyddrtwtyalqkpekenendykel<br>hytalnmelqeyekvrskkllkqvqelekqildkfydfsnnathpedleiedkkgkrhpn<br>fklyitkallkneseiinlenidieilikyydynteklkekiknmdedekakivntkeny<br>nkitnvlikkalvliiirnkmahnqyppkfiydlatrfvpkkeeeyfacyfnrvfetitt<br>elwenkkkakeiv (SEQ ID NO: 584) |
| *Flavobacterium columnare* (NZ_CP016277.1) >WP_065213424.1 | mssknesynkqktfnhykqedkyffggflnnaddnlrqvgkefktrinfnhnnnelasvf<br>kdyfnkeksvakrehalnllsnyfpvleriqkhtnhnfeqtreifellldtikklrdyyt<br>hhyhkpitinpkiydflddtlldvlitikkkkvkndtsrellkeklrpeltqlknqkree<br>likkgkklleenlenavfnhclipfleenktddkqnktvslrkyrkskpneetsitltqs<br>glvflmsfflhrkefqvftsglerfkakvntikeeeislnknnivymithwsysyynfkg<br>lkhriktdqgvstleqnntthsltntntkealltqivdylskvpneiyetlsekqqkefe<br>edineymrenpenedstfssivshkvirkryenkfnyfamrfldeyaelptlrfmvnfgd<br>yikdrqkkilesiqfdseriikkeihlfeklslvteykknvylketsnidlsrfplfpnp |

TABLE 13-continued

| | |
|---|---|
| | syvmannnipfyidsrsnnldeylnqkkkaqsqnkkrnitfekynkeqskdaiiamlqke<br>igvkdlqqrstigllscnelpsmlyevivkdikgaelenkiaqkireqyqsirdftldsp<br>qkdnipttliktintdssvtfenqpidiprlknalqkeltltqekllnvkeheievdnyn<br>rnkntykfknqpknkvddkklqrkyvfyrneirgeanwlasdlihfmknkslwkgymhne<br>lqsflaffedkkndcialletvfnlkedciltkglknlflkhgnfidfykeylklkedfl<br>stestflengfiglppkilkkelskrlkyifivfqkrqfiikeleekknnlyadainlsr<br>gifdekptmipfkkpnpdefaswfvasyqynnyqsfyeltpdiverdkkkkyknlraink<br>vkiqdyylklmvdtlyqdlfnqpldkslsdfyvskaerekikadakayqklndsslwnkv<br>ihlslqnnritanpklkdigkykralqdekiatlltydartwtyalqkpekenendykel<br>hytalnmelqeyekvrskellkqvqelekkildkfydfsnnashpedleiedkkgkrhpn<br>fklyitkallkneseiinlenidieillkyydynteelkekiknmdedekakiintkeny<br>nkitnvlikkalvliiirnkmahnqyppkfiydlanrfvpkkeeeyfatyfnrvfetitk<br>elwenkekkdktqv (SEQ ID NO: 585) |
| *Chryseobacterium*<br>sp. YR477<br>(NZ_KN549099.1)<br>>WP_047431796.1 | metqtighgiaydhskiqdkhffggflnlaennikavlkafsekfnvgnvdvkqfadvsl<br>kdnlpdndfqkrvsflkmyfpvvdfinipnnrakfrsdltltlfksvdqlrnfythyyhkp<br>ldfdaslfilldddifartakevrdqkmkddktrqllsksllseelqkgyelqlerlkelnr<br>lgkkvnihdqlgikngvinnafnhliykdgesfktkltyssaltsfesaengieisqsgl<br>lfllsmflkrkeiedlknrnkgfkakvvidedgkvnglkfmathwvfsylcfkglkskls<br>tefheetlliqiidelskvpdelycafdketrdkfiedineyvkeghqdfsledakvihp<br>virkryenkfnyfairfldefvkfpslrfqvhvgnyvhdrriknidgttfetervvkdri<br>kvfgrlseissykagylssysdkhdetgweifpnpsyvfinnnipihisvdtsfkkeiad<br>fkklrraqvpdelkirgaekkrkfeitqmigsksvinqeepiallslneipallyeilin<br>gkepaeieriikdklnerqdviknynpenwlpasqisrrlrsnkgeriintdkllqlvtk<br>ellvteqklkiisdnrealkqkkegkyirkfiftnselgreaiwladdikrfmpadvrke<br>wkgqyqhsqlqqslafynsrpkealailesswnlkdekiiwnewilksftqnkffdafyne<br>ylkgrkkyfaflsehivqytsnaknlqkfikqqmpkdlfekrhyliedlqteknkilskp<br>fifprgifdkkptfikgvkvedspesfanwyqygyqkdhqfqkfydwkrdysdvflehlg<br>kpfinngdrrtlgmeelkeriiikqdlkikkikiqdlflrliaenlfqkvfkysaklpls<br>dfyltqeermekenmaalqnvreegdkspniikdnfiwskmipykkgqiienavklkdig<br>klnvlslddkvqtllsyddakpwskialenefsigensyevirreklfkeiqqfeseilf<br>rsgwdginhpaqlednrnpkfkmyivngilrksaglysqgediwfeynadfnnldadvle<br>tkselvqlaflvtairnkfahnqlpakefyfyirakygfadepsvalvylnftkyainef<br>kkvmi (SEQ ID NO: 586) |
| *Riemerella*<br>*anatipestifer*<br>ATCC 11845 = DSM<br>15868<br>(NC_014738.1)<br>>WP_004919755A | mekpllpnvytlkhkffwgaflniarhnafiticihineqlglktpsnddkivdvvcetwn<br>nilnndhdllkksqltelilkhfpfltamcyhppkkegkkkghqkeqqkekeseaqsqae<br>alnpskliealeilvnqlhslrnyyshykhkkpdaekdifkhlykafdaslrmvkedyka<br>hftvnitrdfahlnrkgknkqdnpdfnryrfekdgfftesgllfftnlfldkrdaywmlk<br>kvsgfkashkgrekmttevfcrsrillpklrlesrydhnqmlldmlselsrcpkllyekl<br>seennkhfqveadgfldeieeeqnpfkdtlirhqdrfpyfalryldlnesfksirfqvdl<br>gtyhyciydkkigdeqekrhltrtllsfgrlqdfteinrpqewkaltkdldyketsnqpf<br>iskttphyhitdnkigfrlgtskelypsleikdganriakypynsgfvahafisvhellp<br>lmfyqhltgksedllketvrhiqriykdfeeerintiedlekanqgrlplgafpkqmlgl<br>lqnkqpdlsekakikiekliaetkllshrintklkssspklgkrrekliktgvladwlvkd<br>fmrfqpvaydaqnqpiksskanstefwfirralalyggeknrlegyfkqtnligntnphp<br>flnkfnwkacrnlvdfyqqylegrekfleaiknqpwepyqyclllkipkenrknlvkgwe<br>qggisilprglfteairetlsedlmlskpirkeikkhgrvgfisraitlyfkekyqdkhqs<br>fynlsykleakapllkreehyeywqqnkpqsptesqrlelhtsdrwkdyllykrwqhlek<br>klrlyrnqdvmlwlmtleltknhfkelnlnyhqlklenlavnvqeadaklnpinqtlpmv<br>lpvkvypatafgevqyhktpirtvyireehtkalkmgnfkalvkdrringlfsfikeend<br>tqkhpisqlrlrreleiyqslrvdafketlsleekllnkhtslsslenefralleewkke<br>yaassmvtdehiafiasvrnafchnqypfykealhapiplftvaqptteekdglgiaeal<br>lkvlreyceivksqi (SEQ ID NO: 587) |
| *Riemerella*<br>*anatipestifer*<br>RA-CH-2<br>(NC_020125.1)<br>>WP_015345620A | mffsfhnaqrvifkhlykafdaslrmvkedykahftvnitrdfahlnrkgknkqdnpdfn<br>ryrfekdgfftesgllfftnlfldkrdaywmlkkvsgfkashkgrekmttevfcrsrill<br>pklrlesrydhnqmlldmlselsrcpkllyeklseennkhfqveadgfldeieeeqnpfk<br>dtlirhqdrfpyfalryldlnesfksirfqvdlgtyhyciydkkigdeqekrhltrtlls<br>fgrlqdfteinrpqewkaltkdldyketsnqpfiskttphyhitdnkigfrlgtskelyp<br>sleikdganriakypynsgfvahafisvhellplmfyqhltgksedllketvrhiqriyk<br>dfeeerintiedlekanqgrlplgafpkwalgllqnkqpdlsekakikiekliaetklls<br>hrintklkssspklgkrrekliktgvladwlvkdfmrfqpvaydaqnqpiksskanstefw<br>firralalyggeknrlegyfkqtnligntnphpflnkfnwkacrnlvdfyqqylegrekf<br>leaiknqpwepyqyclllkvpkenrknlvkgweqggisilprglfteairetlskdltlsk<br>pirkeikkhgrvgfisraitlyfkekyqdkhqsfynlsykleakapllkkeehyeywqqn<br>kpqsptesqrlelhtsdrwkdyllykrwqhlekklrlyrnqdimlwlmtleltknhfkel<br>nlnyhqlklenlavnvqeadaklnpinqtlpmvlpvkvypttafgevqyhetpirtvyir<br>eeqtkalkmgnfkalvkdrringlfsfikeendtqkhpisqlrlrreleiyqslrvdafk<br>etlsleekllnkhaslsslenefrtlleewkkkyaassmvtdkhiafiasvrnafchnqy<br>pfyketlhapillftvaqptteekdglgiaeallkvlreyceivksqi (SEQ ID NO: 588) |
| *Riemerella*<br>*anatipestifer*<br>(NZ_CP007504.1)<br>>WP_049354263.1 | mffsfhnaqrvifkhlykafdaslrmvkedykahftvnitrdfahlnrkgknkqdnpdfn<br>ryrfekdgfftesgllfftnlfldkrdaywmlkkvsgfkashkgrekmttevfcrsrill<br>pklrlesrydhnqmlldmlselsrcpkllyeklseennkhfqveadgfldeieeeqnpfk<br>dtlirhqdrfpyfalryldlnesfksirfqvdlgtyhyciydkkigdeqekrhltrtlls<br>fgrlqdfteinrpqewkaltkdldyketsnqpfiskttphyhitdnkigfrlgtskelyp<br>sleikdganriakypynsgfvahafisvhellplmfyqhltgksedllketvrhiqriyk<br>dfeeerintiedlekanqgrlplgafpkwalgllqnkqpdlsekakikiekliaetklls |

| | |
|---|---|
| | hrintklksspklgkrrekliktgvladwlvkdfmrfqpvaydaqnqpiksskanstefw<br>firrralalyggeknrlegyfkqtnligntnphpflnkfnwkacrnlvdfyqqylegrekf<br>leaiknqpwepyqyclllkipkenrknlvkgweqggislprglfteairetlsedlmlsk<br>pirkeikkhgrvgfisraitlyfkekyqdkhqsfynlsykleakapllkreehyeywqqn<br>kpqsptesqrlelhtsdrwkdyllykrwqhlekklrlyrnqdvmlwlmtleltknhfkel<br>nlnyhqlklenlavnvqeadaklnpinqtlpmvlpvkvypatafgevqyhktpirtvyir<br>eehtkalkmgnfkalvkdrringlfsfikeendtqkhpisqlrlrreleiyqslrvdafk<br>etlsleekllnkhtslsslenefralleewkkeyaassmvtdehiafiasvrnafchnqy<br>pfykealhapiplfftvaqptteekdglgiaeallkvlreyceivksqi (SEQ ID NO: 589) |
| *Riemerella anatipestifer* (NZ_LUDU01000012.1) >WP_061710138A | mffsfhnaqrvifkhlykafdaslrmvkedykahftvnitrdfahlnrkgknkqdnpdfn<br>ryrfekdgfftesgllfftnlfldkrdaywmlkkvsgfkashkqsekmttevfcrsrill<br>pklrlesrydhnqmlldmlselsrcpkllyeklsekdkkcfqveadgfldeieeeqnpfk<br>dtlirhqdrfpyfalryldlnesfksirfqvdlgtyhyciydkkigyegekrhltrtlln<br>fgrlqdfteinrpqewkaltkdldynetsnqpfiskttphyhitdnkigfrlrtskelyp<br>slevkdganriakypynsdfvahafisisvhellplmfyqhltgksedllketvrhiqri<br>ykdfeeerintiedlekanqgrlplgafpkwalgllqnkqpdlsekakikiekliaetkl<br>lshrintklksspklgkrrekliktgvladwlvkdfmrfqpvaydaqnqpiksskanste<br>srlirralalyggeknrlegyfkqtnligntnphpflnkfnwkacrnlvdfyqqylegre<br>kfleaikhqpwepyqyclllkvpkenrknlvkgweqggislprglfteairetlskdltl<br>skpirkeikkhgrvgfisraitlyfkekyqdkhqsfynlsykleakapllkkeehyeywq<br>qnkpqsptesqrlelhtsdrwkdyllykrwqhlekklrlyrnqdimlwlmtleltknhfk<br>elnlnyhqlklenlavnvqeadaklnpinqtlpmvlpvkvypttafgevqyhetpirtvy<br>ireeqtkalkmgnfkalvkdrhinglfsfikeendtqkhpisqlrlrreleiyqslrvda<br>fketlsleekllnkhaslsslenefrtlleewkkkyaassmvtdkhiafiasvrnafchn<br>qypfyketlhapillfftvaqptteekdglgiaeallrvlreyceivksqi (SEQ ID NO: 590) |
| *Riemerella anatipestifer* (NZ_LUDI01000010.1) >WP_064970887.1 | mekplppnvytlkhkffwgaflniarhnafitichineqlglttppnddkiadvvcgtwn<br>nilnndhdllkksqltelilkhfpflaamcyhppkkegkkkgsqkeqqkekeneaqsqae<br>alnpselikvlktivkqlrtlrnyyshhshkkpdaekdifkhlykafdaslrmvkedyka<br>hftvnitqdfahlnrkgknkqdnpdfdryrfekdgfftesgllfftnlfldkrdaywmlk<br>kvsgfkashkgsekmttevfcrsrillpklrlesrydhnqmlldmlselsrypkllyekl<br>seedkkrfqveadgfldeieeeqnpfkdtlirhqdrfpyfalryldlnesfksirfqvdl<br>gtyhyciydkkigdeqekrhltrtllsfgrlqdfteinrpqewkaltkdldyketskqpf<br>iskttphyhitdnkigfrlgtskelypslevkdganriaqypynsdfvahafisvhellp<br>lmfyqhltgksedllketvrhiqriykdfeeerintiedlekanqgrlplgafpkqmlgl<br>lqnkqpdlsekakikiekliaetkllshrintklksspklgkrrekliktgvladwlvkd<br>fmrfqpvaydaqnqpiessskanstefqliqralalyggeknrlegyfkqtnligntnphp<br>flnkfnwkacrnlvdfyqqylegrekfleaiknqpwepyqyclllkipkenrknlvkgwe<br>qggislprglfteairetlskdltlskpirkeikkhgrvgfisraitlyfrekyqddhqs<br>fydlpykleakasplpkkehyeywqqnkpqsptelqrlelhtsdrwkdyllykrwqhlek<br>klrlyrnqdvmlwlmtleltknhfkelnlnyhqlklenlavnvqeadaklnpinqtlpmv<br>lpvkvypatafgevqygetpirtvyireeqtkalkmgnfkalvkdrringlfsfikeend<br>tqkhpisqlrlrreleiyqslrvdafketlnleekllkkhtslssvenkfrilleewkke<br>yaassmvtdehiafiasvrnafchnqypfyeealhapiplfftvaqqtteekdglgiaeal<br>lrvlreyceivksqi (SEQ ID NO: 591) |
| *Prevotella saccharolytica* F0055 AMEP01000091.1) >EKY00089.1 | mmekenvqgshiyyeptdkcfwaafynlarhnayltiahinsfvnskkginnddkvldii<br>ddwskfdndllmgarinklilkhfpflkaplyglakrktrkqqgkeqqdyekkgdedpev<br>igeaianafkmanvrktlhaflkqledlrnhfshynynspakkmevkfddgfcnklyyvf<br>daalqmvkddnrmnpeinmqtdfehlvrlgrnrkipntfkynftnsdgtinnngllffvs<br>lflekrdaiwmqkkikgfkggtenymrmtnevfcrnrmvipklrlntkdydnhqlmfdmln<br>elvrcplslykrlkqedqdkfrvpiefldednendnpygenansdenpteetdplkntiv<br>rhqhrfpyfvlryfdlnevfkqlrfqinlgcyhfsiydktigertekrhltrtlfgfdrl<br>qnfsvklqpehwknmvkhldteessdkpylsdamphyqienekigihflktdtekketvw<br>psleveevssnrnkykseknitadaflsthellpmmfyyqllsseektraaagdkvqgvl<br>qsyrkkifdiyddfangtinsmqklderlakdnllrgnmpqqmlailehqepdmegkake<br>kldrlitetkkrigkledqfkqkvrigkrradlpkvgsiadwlvndmmrfqpakrnadnt<br>gvpdskansteyrllgealafysaykdrlepyfrqvnliggtnphpflhrvdwkkcnhll<br>sfyhdyleakeqylshlspadwqkhqhflllkvrkdignekkdwkkslvagwkngfnlpr<br>glftesiktwfstdadkvqitdtklfenrvgliakliplyydkvyndkpqpfyqypfnin<br>drykpedtrkrftaasssklwnekkmlyknaqpdssdkieypqyldflswkklerelrmlr<br>nqdmmvwlmckdlfaqctvegvefadlklsqlevdvnvqdnlnvinnvssmilplsvyps<br>daqgnvlrnskplhtvyvqennkllkqgnfksllkdrringlfsfiaaegedlqqhplt<br>knrleyelsiyqtmrisvfeqtlqlekailtrnkticgnnfnnllnswsehrtdkktlqp<br>didfliavrnafshnqypmstntvmqgiekfniqtpkleekdglgiasqlakktkdaasr<br>lqniinggtn (SEQ ID NO: 592) |
| *Prevotella saccharolytica* JCM 17484 (NZ_BAKN01000001.1) >WP_051522484.1 | medkpfwaaffnlarhnvyltvnhinklldleklydegkhkeiferedifnisddvmnda<br>nsngkkrkldikkiwddldtdltrkyqlrelilkhfpfiqpaiigaqtkerttidkdkrs<br>tstsndslkqtgegdindllslsnvksmffrllqileqlrnyyshvkhsksatmpnfded<br>llnwmryifidsvnkvkedyssnsvidpntsfshliykdeqgkikperypftskdgsina<br>fgllffvslflekqdsiwmqkkipgfkkasenymkmtnevfcrnhillpkirletvydkd<br>wmlldmlnevvrcplslykrltpaaqnkfkvpekssdnanrqeddnpfsrilvrhqnrfp<br>yfvlrffdlnevfttlrfqinlgcyhfaickkqigdkkevhhlirtlygfsrlqnftqnt<br>rpeewntivkttepssgndgktvqgvplpyisytiphyqienekigikifdgtavdtdi<br>wpsystekqlnkpdkytltpgfkadvflsvhellpmmfyyqlllcegmlktdagnavekv<br>lidtrnaifnlydafvqekintitdlenylqdkpilighlpkqmidllkghqrdmlkave |

TABLE 13-continued

| | |
|---|---|
| | qkkamlikdterrlklldkqlkqetdvaakntgtllkngqiadwlvndmmrfqpvkrdke<br>gnpincskansteyqmlqrafafyatdscrlsryftqlhlihsdnshlflsrfeydkqpn<br>liafyaaylkakleflnelqpqnwasdnyflllrapkndrqklaegwkngfnlprglfte<br>kiktwfnehktivdisdcdifknrvgqvarlipvffdkkfkdhsqpfyrydfnvgnvskp<br>teanylskgkreeelfksyqnkfknnipaektkeyreyknfslwkkferelrliknqdili<br>wlmcknlfdekikpkkdilepriaysyikldslqtntstagslnalakvvpmtlaihids<br>pkpkgkagnnekenkeftvyikeegtkllkwgnfktlladrrikglfsyiehddidlkqh<br>pltkrrvdleldlyqtcridifqqtlgleaqlldkysdlntdnfyqmligwrkkegiprn<br>ikedtdflkdvrnafshnqypdskkiafrrirkfnpkelileeeeglgiatqmykevekv<br>vnrikrielfd (SEQ ID NO: 593) |
| *Prevotella buccae*<br>ATCC 33574<br>(AEPD01000005.1)<br>>EFU31981.1 | mqkqdklfvdrkknaifafpkyitimenkekpepiyyeltdkhfwaaflnlarhnvytti<br>nhinrrleiaelkddgymmgikgswneqakkldkkvrlrdlimkhfpfleaaayemtnsk<br>spnnkegrekeqsealslnnlknvlfiflekqvlrnyyshykyseespkpifetsllkn<br>mykvfdanvrlvkrdymhhenidmqrdfthlnrkkqvgrtkniidspnfhyhfadkegnm<br>tiagllffvslfldkkdaiwmqkklkgfkdgrnlreqmtnevfcrsrislpklklenvqt<br>kdwmqldmlnelvrcpkslyerlrekdresfkvpfdifsddynaeeepfkntivrhqdrf<br>pyfvlryfdlneifeqlrfqidlgtyhfsiynkrigdedevrhlthhlygfariqdfapq<br>nqpeewrklvkdldhfetsgepyisktaphyhlenekigikfcsahnnlfpslqtdktcn<br>grskfnlgtqftaeaflsvhellpmmfyyllltkdysrkesadkvegiirkeisniyaiy<br>dafanneinsiadltrrlqntnilqghlpkqmisilkgrqkdmgkeaerkigemiddtqr<br>rldllckqtnqkirigkrnagllksgkiadwlvndmmrfqpvqkdqnnipinnskanste<br>yrmlqralalfgsenfrlkayfnqmnlvgndnphpflaetqwehqtnilsfyrnyleark<br>kylkglkpqnwkqyhflilkvqktnrntivtgwknsfnlprgiftqpirewfekhnnsk<br>riyqdgilsfdrvgfvakaiplyfaeeykdnvqpfydypfnignrlkpkkrqfldkkerve<br>lwqknkelfknypsekkktdlayldflswkkferelrliknqdivtwlmfkelfnmatve<br>glkigeihlrdidtntaneesnnilnrimpmklpvktyetdnkgnilkerplatfyieet<br>etkvlkqgnfkalvkdrringlfsfaettdlnleehpisklsvdlelikyqttrisifem<br>tlglekklidkystlptdsfrnmlerwlqckanrpelknyvnsliavrnafshnqypmyd<br>atlfaevkkftlfpsvdtkkielniapqlleivgkaikeieksenkn (SEQ ID NO: 594) |
| *Prevotella buccae*<br>ATCC 33574<br>(NZ_GL586311.1)<br>>WP_004343973.1 | mqkqdklfvdrkknaifafpkyitimenkekpepiyyeltdkhfwaaflnlarhnvytti<br>nhinrrleiaelkddgymmgikgswneqakkldkkvrlrdlimkhfpfleaaayemtnsk<br>spnnkegrekeqsealslnnlknvlfiflekqvlrnyyshykyseespkpifetsllkn<br>mykvfdanvrlvkrdymhhenidmqrdfthlnrkkqvgrtkniidspnfhyhfadkegnm<br>tiagllffvslfldkkdaiwmqkklkgfkdgrnlreqmtnevfcrsrislpklklenvqt<br>kdwmqldmlnelvrcpkslyerlrekdresfkvpfdifsddynaeeepfkntivrhqdrf<br>pyfvlryfdlneifeqlrfqidlgtyhfsiynkrigdedevrhlthhlygfariqdfapq<br>nqpeewrklvkdldhfetsgepyisktaphyhlenekigikfcsahnnlfpslqtdktcn<br>grskfnlgtqftaeaflsvhellpmmfyyllltkdysrkesadkvegiirkeisniyaiy<br>dafanneinsiadltrrlqntnilqghlpkqmisilkgrqkdmgkeaerkigemiddtqr<br>rldllckqtnqkirigkrnagllksgkiadwlvndmmrfqpvqkdqnnipinnskanste<br>yrmlqralalfgsenfrlkayfnqmnlvgndnphpflaetqwehqtnilsfyrnyleark<br>kylkglkpqnwkqyhflilkvqktnrntivtgwknsfnlprgiftqpirewfekhnnsk<br>riyqdgilsfdrvgfvakaiplyfaeeykdnvqpfydypfnignrlkpkkrqfldkkerve<br>lwqknkelfknypsekkktdlayldflswkkferelrliknqdivtwlmfkelfnmatve<br>glkigeihlrdidtntaneesnnilnrimpmklpvktyetdnkgnilkerplatfyieet<br>etkvlkqgnfkalvkdrringlfsfaettdlnleehpisklsvdlelikyqttrisifem<br>tlglekklidkystlptdsfrnmlerwlqckanrpelknyvnsliavrnafshnqypmyd<br>atlfaevkkftlfpsvdtkkielniapqlleivgkaikeieksenkn (SEQ ID NO: 595) |
| *Prevotella buccae*<br>D17<br>(NZ_GG739967.1)<br>>WP_004343581.1 | mqkqdklfvdrkknaifafpkyitimengekpepiyyeltdkhfwaaflnlarhnvytti<br>nhinrrleiaelkddgymmdikgswneqakkldkkvrlrdlimkhfpfleaaayeitnsk<br>spnnkegrekeqsealslnnlknvlfiflekqvlrnyyshykyseespkpifetsllkn<br>mykvfdanvrlvkrdymhhenidmqrdfthlnrkkqvgrtkniidspnfhyhfadkegnm<br>tiagllffvslfldkkdaiwmqkklkgfkdgrnlreqmtnevfcrsrislpklklenvqt<br>kdwmqldmlnelvrcpkslyerlrekdresfkvpfdifsddydaeeepfkntivrhqdrf<br>pyfvlryfdlneifeqlrfqidlgtyhfsiynkrigdedevrhlthhlygfariqdfaqq<br>nqpevwrklvkdldyfeasqepyipktaphyhlenekigikfcsthnnlfpslktektcn<br>grskfnlgtqftaeaflsvhellpmmfyyllltkdysrkesadkvegiirkeisniyaiy<br>dafangeinsiadltcrlqktnilqghlpkqmisilegrqkdmekeaerkigemiddtqr<br>rldllckqtnqkirigkrnagllksgkiadwlvndmmrfqpvqkdqnnipinnskanste<br>yrmlqralalfgsenfrlkayfnqmnlvgndnphpflaetqwehqtnilsfyrnyleark<br>kylkglkpqnwkqyhflilkvqktnrntivtgwknsfnlprgiftqpirewfekhnnsk<br>riyqdgilsfdrvgfvakaiplyfaeeykdnvqpfydypfnignrlkpqkgqfldkkerve<br>lwqknkelfknypsekkktdlayldflswkkferelrliknqdivtwlmfkelfnmatve<br>glkigeihlrdidtntaneesnnilnrimpmklpvktyetdnkgnilkerplatfyieet<br>etkvlkqgnfkvlakdrringllsfaettdidleknpitklsvdhelikyqttrisifem<br>tlglekklinkyptlptdsfrnmlerwlqckanrpelknyvnsliavrnafshnqypmyd<br>atlfaevkkftlfpsvdtkkielniapqlleivgkaikeieksenkn (SEQ ID NO: 596) |
| *Prevotella*<br>sp. MSX73<br>(NZ_ALJQ01000043.1)<br>>W1_007412163.1 | mqkqdklfvdrkknaifafpkyitimengekpepiyyeltdkhfwaaflnlarhnvytti<br>nhinrrleiaelkddgymmgikgswneqakkldkkvrlrdlimkhfpfleaaayeitnsk<br>spnnkegrekeqsealslnnlknvlfiflekqvlrnyyshykyseespkpifetsllkn<br>mykvfdanvrlvkrdymhhenidmqrdfthlnrkkqvgrtkniidspnfhyhfadkegnm<br>tiagllffvslfldkkdaiwmqkklkgfkdgrnlreqmtnevfcrsrislpklklenvqt<br>kdwmqldmlnelvrcpkslyerlrekdresfkvpfdifsddydaeeepfkntivrhqdrf |

| | |
|---|---|
| | pyfvlryfdlneifeqlrfqidlgtyhfsiynkrigdedevrhlthhlygfariqdfapq<br>nqpeewrklvkdldhfetsgepyisktaphyhlenekigikfcsthnnlfpslkrektcn<br>grskfnlgtqftaeaflsvhellpmmfyyllltkdysrkesadkvegiirkeisniyaiy<br>dafanneinsiadltcrlqktnilqghlpkqmisilegrqkdmekeaerkigemiddtqr<br>rldllckqtnqkirigkrnagllksgkiadwlvsdmmrfqpvqkdtnnapinnskanste<br>yrmlqhalalfgsessrlkayfrqmnlvgnanphpflaetqwehqtnilsfyrnyleark<br>kylkglkpqnwkqyqhflilkvqktnrntivtgwknsfnlprgiftqpirewfekhnnsk<br>riydgilsfdrvgfvakaiplyfaeeykdnvqpfydypfnignklkpqkgqfldkkerve<br>lwqknkelfknypseknktdlayldflswkkferelrliknqdivtwlmfkelfktttve<br>glkigeihlrdidtntaneesnnilnrimpmklpvktyetdnkgnilkerplatfyieet<br>etkvlkqgnfkvlakdrringllsfaettdidleknpitklsvdyelikyqttrisifem<br>tlglekklidkystlptdsfrnmlerwlqckanrpelknyvnsliavrnafshnqypmyd<br>atlfaevkkftlfpsvdtkkielniapqlleivgkaikeieksenkn (SEQ ID NO: 597) |
| Prevotella pallens<br>ATCC 700821<br>(AFPY01000052.1)<br>>EGQ18444.1 | mkeeekgktpvvstynkddkhfwaaflnlarhnvyitvnhinkilgegeinrdgyentle<br>kswneikdinkkdrlskliikhfpflevttyqrnsadttkqkeekqaeaqsleslkksff<br>vfiyklrdlrnhyshykhskslerpkfeedlqekmynifdasiqlvkedykhntdiktee<br>dfkhldrkgqfkysfadnegnitesgllffvslflekkdaiwvqkklegfkcsnesyqkm<br>tnevfcrsrmllpklrlqstqtqdwilldmlnelircpkslyerlreedrkkfrvpieia<br>dedydaeqepfknalvrhqdrfpyfalryfdyneiftnlrfqidlgtyhfsiykkqigdy<br>keshhlthklygferigeftkqnrpdewrkfvktfnsfetskepyipettphyhlenqki<br>girfrndndkiwpslktnseknekskykldksfqaeaflsvhellpmmfyyllktentd<br>ndneietkkkenkndkqekhkieeiienkiteiyalydafangkinsidkleeyckgkdi<br>eighlpkqmiailksehkdmateakrkqeemladvqksleslkdnqineeienverknssl<br>ksgeiaswlvndmmrfqpvqkdnegnpinnskansteyqmlqrslalynkeekptryfrq<br>vnliessnphpflnntewekcnnilsfyrsyleakknfleslkpedweknqyflmlkepk<br>tncetivqgwkngfnlprgiftepirkwfmehrknitvaelkrvglvakviplffseeyk<br>dsvqpfynylfnvgninkpdeknflnceerrellrkkkdefkkmtdkekeenpsylefqs<br>wnkferelrlvrnqdivtwllcmelfnkkkikelnvekiylknintnttkkeknteekng<br>eekiikeknnilnrimpmrlpikvygrenfsknkkkkirrntfftvyieekgtkllkqgn<br>fkalerdrrlgglfsfvkthskaesksntisksrveyelgeyqkarieiikdmlaleetl<br>idkynsldtdnfhnmltgwlklkdepdkasfqndvdlliavrnafshnqypmrnriafan<br>inpfslssantseekglgianqlkdkthktiekiieiekpietke (SEQ ID NO: 598) |
| Prevotella pallens<br>ATCC 700821<br>(NZ_GL982513.1)<br>>WP_006044833.1 | mkeeekgktpvvstynkddkhfwaaflnlarhnvyitvnhinkilgegeinrdgyentle<br>kswneikdinkkdrlskliikhfpflevttyqrnsadttkqkeekqaeaqsleslkksff<br>vfiyklrdlrnhyshykhskslerpkfeedlqekmynifdasiqlvkedykhntdiktee<br>dfkhldrkgqfkysfadnegnitesgllffvslflekkdaiwvqkklegfkcsnesyqkm<br>tnevfcrsrmllpklrlqstqtqdwilldmlnelircpkslyerlreedrkkfrvpieia<br>dedydaeqepfknalvrhqdrfpyfalryfdyneiftnlrfqidlgtyhfsiykkqigdy<br>keshhlthklygferigeftkqnrpdewrkfvktfnsfetskepyipettphyhlenqki<br>girfrndndkiwpslktnseknekskykldksfqaeaflsvhellpmmfyyllktentd<br>ndneietkkkenkndkqekhkieeiienkiteiyalydafangkinsidkleeyckgkdi<br>eighlpkqmiailksehkdmateakrkqeemladvqksleslkdnqineeienverknssl<br>ksgeiaswlvndmmrfqpvqkdnegnpinnskansteyqmlqrslalynkeekptryfrq<br>vnliessnphpflnntewekcnnilsfyrsyleakknfleslkpedweknqyflmlkepk<br>tncetivqgwkngfnlprgiftepirkwfmehrknitvaelkrvglvakviplffseeyk<br>dsvqpfynylfnvgninkpdeknflnceerrellrkkkdefkkmtdkekeenpsylefqs<br>wnkferelrlvrnqdivtwllcmelfnkkkikelnvekiylknintnttkkeknteekng<br>eekiikeknnilnrimpmrlpikvygrenfsknkkkkirrntfftvyieekgtkllkqgn<br>fkalerdrrlgglfsfvkthskaesksntisksrveyelgeyqkarieiikdmlaleetl<br>idkynsldtdnfhnmltgwlklkdepdkasfqndvdlliavrnafshnqypmrnriafan<br>inpfslssantseekglgianqlkdkthktiekiieiekpietke (SEQ ID NO: 599) |
| Prevotella<br>intermedia<br>ATCC 25611 = DSM<br>20706<br>NZ_JAEZ01000017.1)<br>>WP_036860899.1 | meddkkttdsiryelkdkhfwaaflnlarhnvyitvnhinkileegeinrdgyettlknt<br>wneikdinkkdrlskliikhfpfleaatyrinptdttkqkeekqaeaqsleslrksffvf<br>iyklrdlrnhyshykhskslerpkfeegllekmynifnasirlvkedyqynkdinpdedf<br>khldrteeefnyyftkdnegnitesgllffvslflekkdaiwmqqkllgfkdnrenkkkm<br>tnevfcrsrmllpklrlqstqtqdwilldmlnelircpkslyerlreedrekfrvpieia<br>dedydaeqepfkntivrhqdrfpyfalryfdyneiftnlrfqidlgtyhfsiykkqigdy<br>keshhlthklygferigeftkqnrpdewrkfvktfnsfetskepyipettphyhlenqki<br>girfrndndkiwpslktnseknekskykldksfqaeaflsvhellpmmfyyllktentd<br>ndneietkkkenkndkqekhkieeiienkiteiyalydtfangeiksideleeyckgkdi<br>eighlpkqmiailkdehkvmateaerkqeemlvdvqksleslkdnqineeienverknssl<br>ksgkiaswlvndmmrfqpvqkdnegkpinnskansteyqllqrtlaffgseherlapyfk<br>qtkliessnphpflkdtewekcnnilsfyrsyleakknfleslkpedweknqyflklkep<br>ktkpktivqgwkngfnlprgiftepirkwfmkhrenitvaelkrvglvakviplffseey<br>kdsvqpfynyhfnvgninkpdeknflnceerrellrkkkdefkkmtdkekeenpsylefk<br>swnkferelrlvrnqdivtwllcmelfnkkkikelnvekiylknintnttkkeknteekn<br>geeknikeknnilnrimpmrlpikvygrenfsknkkkkirrntfftvyieekgtkllkqg<br>nfkalerdrrlgglfsfvktpskaesksntisklrveyelgeyqkarieiikdmlalekt<br>lidkynsldtdnfnkmltdwlelkgepdkasfqndvdlliavrnafshnqypmrnriafa<br>ninpfslssantseekglgianqlkdkthktiekiieiekpietke (SEQ ID NO: 600) |

TABLE 13-continued

| | |
|---|---|
| *Prevotella intermedia* (NZ_LBGT01000010.1) >WP_061868553.1 | meddkkttdsiryelkdkhfwaaflnlarhnvyitvnhinkileedeinrdgyentlens wneikdinkkdrlsklikhfpfleattyrqnptdttkqkeekqaeaqsleslkksffvf iyklrdlrnhyshykhskslerpkfeedlqnkmynifdvsiqfvkedykhntdinpkkdf khldrkrkgkfhysfadnegnitesgllffvslflekkdaiwvqkklegfkcsnksyqkm tnevfcrsrmllpklrlestqtqdwilldmlnelircpkslyerlqgvnrkkfyvsfdpa dedydaeqepfkntivrhqdrfpyfalryfdynevfanlrfqidlgtyhfsiykkliggq kedrhlthklygferigefdkqnrpdewkaivkdsdtfkkkeekeeekpyisettphyhl enkkigiafknhniwpstqteltnnkrkkynlgtsikaeaflsvhellpmmfyylllkte ntkndnkvggkketkkqgkhkieaiieskikdiyalydafangeinsedelkeylkgkdi kivhlpkqmiailknehkdmaekaeakqekmklatenrlktldkqlkgkiqngkrynsap ksgeiaswlvndmmrfqpvqkdengeslnnskansteyqllqrtlaffgseherlapyfk qtkliessnphpflndtewekcsnilsfyrsylkarknfleslkpedweknqyflmlkep ktnretivqgwkngfnlprgfftepirkwfmehwksikvddlkrvglvakvtplffseky kdsvqpfynypfnvgdvnkpkeedflhreerielwdkkkdkfkgykakkkfkemtdkeke ehrsylefqswnkferelrlvrnqdivtwllctelidklkidelnikelkklrlkdintd takkeknnilnrvmpmelpvtvykvnkggyiiknkplhtiyikeaetkllkqgnfkalvk drringlfsfvktpseaesesnpisklrveyelgkyqnarldiiedmlalekklidkyns ldtdnfhnmltgwlelkgeakkarfqndvklltavrnafshnqypmydenlfgnierfsl sssniieskgldiaaaklkeevskaakkigneednkkeket (SEQ ID NO: 601) |
| *Prevotella intermedia* 17 (CP003502.1) >AFJ07523.1 | mkmeddkktkestnmldnkhfwaaflnlarhnvyitvnhinkvlelknkkdqdiiidndq dilaikthwekvngdlnkterlrelmtkhfpfletaiytknkedkeevkqekqakaqsfd slkhclflfleklqearnyyshykysestkepmlekellkkmynifddniqlvikdyqhn kdinpdedfkhldrteeefnyyfttnkkgnitasgllffvslflekkdaiwmqqklrgfk dnreskkkmthevfcrsrmllpklrlestqtqdwilldmlnelircpkslyerlqgeyrk kfnvpfdsadedydaeqepfkntivrhqdrfpyfalryfdyneiftnlrfqidlgtyhfs iykkliggqkedrhlthklygferigefakqnrtdewkaivkdfdtyetseepyisetap hyhlenqkigirfrndndeiwpslktngennekrkykldkqyqaeaflsvhellpmmfyy llllkkeepnndkknasivegfikreirdiyklydafangeinniddlekycedkgiprh lpkqmvailydehkdmaeeakrkqkemvkdtkkllatlekqtqgeiedggrnirllksge iarwlvndmmrfqpvqkdnegnpinnskansteyqmlqrslalynkeekptryfrqvnli nssnphpflkwtkweecnnilsfyrsyltkkieflnklkpedweknqyflklkepktnre tivqgwkngfnlprgiftepirewfkrhqndseeyekvetldrvglvtkviplffkkeds kdkeeylkkdaqkeinncvqpfygfpynvgnihkpdekdflpseerkklwgdkkykfkgy kakvkskkltdkekeeyrsylefqswnkferelrlvrnqdivtwllctelidklkveglnveelkklrlkdidtdtakqeknnilnrvmpmqlpvtvyeiddshnivkdrplhtvyieet ktkllkqgnfkalvkdrringlfsfvdtssetelksnpiskslveyelgeranarietik dmilleetliekyktlptdnfsdmlngwlegkdeadkarfqndvkllavrnafshnqyp mrnriafaninpfslssadtseekkldianqlkdkthkiikriieiekpietke (SEQ ID NO: 602) |
| *Prevotella intermedia* (NZ_AP014926.1) >WP_050955369.1 | meddkktkestnmldnkhfwaaflnlarhnvyitvnhinkvlelknkkdqdiiidndqdi laikthwekvngdlnkterlrelmtkhfpfletaiytknkedkeevkqekqakaqsfdsl khclflfleklqearnyyshykysestkepmlekellkkmynifddniqlvikdyqhnkd inpdedfkhldrteeefnyyfttnkkgnitasgllffvslflekkdaiwmqqklrgfkdn reskkkmthevfcrsrmllpklrlestqtqdwilldmlnelircpkslyerlqgeyrkkf nvpfdsadedydaeqepfkntivrhqdrfpyfalryfdyneiftnlrfqidlgtyhfsiy kkliggqkedrhlthklygferigefakqnrtdewkaivkdfdtyetseepyisetaphy hlenqkigirfrndndeiwpslktngennekrkykldkqyqaeaflsvhellpmmfyyll lkkeepnndkknasivegfikreirdiyklydafangeinniddlekycedkgiprhlp kqmvailydehkdmaeeakrkqkemvkdtkkllatlekqtqgeiedggrnirllksgeia rwlvndmmrfqpvqkdnegnpinnskansteyqmlqrslalynkeekptryfrqvnlins snphpflkwtkweecnnilsfyrsyltkkieflnklkpedweknqyflklkepktnretl vqgwkngfnlprgiftepirewfkrhqndseeyekvetldrvglvtkviplffkkedskd keeylkkdaqkeinncvqpfygfpynvgnihkpdekdflpseerkklwgdkkykfkgyka kvkskkltdkekeeyrsylefqswnkferelrlvrnqdivtwllctelidklkveglnve elkklrlkdidtdtakqeknnilnrvmpmqlpvtvyeiddshnivkdrplhtvyieetkt kllkqgnfkalvkdrringlfsfvdtssetelksnpiskslveyelgeranarietikdm llleetliekyktlptdnfsdmlngwlegkdeadkarfqndvkllavrnafshnqypmr nriafaninpfslssadtseekkldianqlkdkthkiikriieiekpietke (SEQ ID NO: 603) |
| *Prevotella intermedia* (AP014598.1) BAU18623.1 | meddkkttdsisyelkdkhfwaaflnlarhnvyitvnhinkvlelknkkdqdiiidndqd ilaikthwekvngdlnkterlrelmtkhfpfletaiysknkedkeevkqekqakaqsfds lkhclflfleklqetrnyyshykysestkepmlekellkkmynifddniqlvikdyqhnk dinpdedfkhldrteedfnyyftrnkkgnitesgllffvslflekkdaiwmqqklrsgfkd nreskkkmthevfcrsrmllpklrlestqtqdwilldmlnelircpkslyerlqgedrek fkvpfdpadedydaeqepfkntivrhqdrfpyfalryfdyneiftnlrfqidlgtfhfsi ykkliggqkedrhlthklygferigefakqnrpdewkaivkdldtyetsneryisettph yhlenqkigirfrndndeiwpslktngenneskykldkqyqaeaflsvhellpmmfyyl lkkeepnndkknasivegfikreirdmyklydafangeinniddlekycedkgiprhl pkqmvailydehkdmvkeakrkqrkmvkdteklllaalekqtqektedggrnirllksgei arwlvndmmrfqpvqkdnegnpinnskansteyqmlqrslalynkeekptryfrqvnlin ssnphpflkwtkweecnnilsfyrsyltkkieflnklkpedweknqyflklkepktnret lvqgwkngfnlprgiftepirewfkrhqndskeyekvealdrvglvtkviplffkkedsk dkeedlkkdaqkeinncvqpfysfpynvgnihkpdekdflhreerielwdkkkdkfkgyk akvkskkltdkekeeyrsylefqswnkferelrlvrnqdivtwllctelidklkveglnv eelkklrlkdidtdtakqeknnilnrvmpmqlpvtvyeiddshnivkdrplhtvyieetk tkllkqgnfkalvkdrringlfsfvdtsseaelksnpiskslveyelgepanarietikd |

TABLE 13-continued

| | |
|---|---|
| | mllleetliekyknlptdnfsdmlngwlegkdeadkarfqndvkllvavrnafshnqypm<br>rnriafaninpfslssadtseekkldianqlkdkthkiikriieiekpietke (SEQ<br>ID NO: 604) |
| *Prevotella*<br>*intermedia* ZT<br>(ATMK01000017.1)<br>>KJJ86756.1 | mkmeddkkttestnmldnkhfwaaflnlarhnvyitvnhinkvlelknkkdqdiiidndq<br>dilaikthwekvngdlnkterlrelmtkhfpfletaiytknkedkeevkqekqaeaqsle<br>slkdclflfleklqearnyyshykysestkepmleegllekmynifddniqlvikdyqhn<br>kdinpdedfkhldrkgqfkysfadnegnitesgllffvslflekkdaiwmqqkltgfkdn<br>reskkkmthevfcrrrmllpklrlestqtqdwilldmlnelircpkslyerlqgeyrkkf<br>nvpfdsadedydaeqepfkntivrhqdrfpyfalryfdyneiftnlrfqidlgtyhfsiy<br>kkliggqkedrhlthklygferigefakqnrpdewkalvkdldtyetsneryisettphy<br>hlenqkigirfrngnkeiwpslktngennekskykldkpyqaeaflsvhellpmmfyyll<br>kkeepnndkknasivegfikreirdmyklydafangeinnigdlekycedkgipkrhlp<br>kqmvailydepkdmvkeakrkqkemvkdtkkllatlekqtqeeiedggrnirllksgeia<br>rwlvndmmrfqpvqkdnegnpinnskansteyqmlqrslalynkeekptryfrqvnlins<br>snphpflkwtkweecnnilsfyrnyltkkieflnklkpedweknqyflklkepktnretl<br>vqgwkngfnlprgiftepirewfkrhqndskeyekvealkrvglvtkviplffkeeyfke<br>daqkeinncvqpfysfpynvgnihkpdekdflpseerkklwgdkkdkfkgykakvkskkl<br>tdkekeeyrsylefqswnkferelrlvrnqdivtwllctelidkmkveglnveelqklrl<br>kdidtdtakqeknnilnrimpmqlpvtvyeiddshnivkdrplhtvyieetktkllkqgn<br>fkalvkdrringlfsfvdtsskaelkdkpisksvveyelgepanarietikdmillektl<br>ikkyeklptdnfsdmlngwlegkdesdkarfqndvkllvavrnafshnqypmrnriafan<br>inpfslssadiseekkldianqlkdkthkiikkiieiekpietke (SEQ ID NO:<br>605) |
| *Prevotella*<br>*aurantiaca*<br>JCM 15754<br>NZ_BAKF01000019.1)<br>>WP_025000926.1 | meddkkttgsisyelkdkhfwaaflnlarhnvyitinhinkllleireidndekvldiktl<br>wqkgnkdlnqkarlrelmtkhfpfletaiytknkedkkevkqekqaeaqsleslkdclfl<br>fldklqearnyyshykysefskepefeegllekmynifgnniqlvindyqhnkdinpded<br>fkhldrkgqfkysfadnegnitesgllffvslflekkdaiwmqqkltgfkdnlenkkkmt<br>hevfcrsrilmpklrlestqtqdwilldmlnelircpkslyerlqgddrekfkvpfdpad<br>edynaeqepfkntlirhqdrfpyfvlryfdyneifknlrfqidlgtyhfsiykkliggqk<br>edrhlthklygferigefakqnrpdewkaivkdldtyetsnkryisettphyhlenqkig<br>irfrngnkeiwpslktndennekskykldkqyqaeaflsvhellpmmfyyllllkkekpnn<br>deinasivegfikreirnifklydafangeinniddlekycadkgipkrhlpkqmvaily<br>dehkdmvkeakrkqkemvkdtkkllatlekqtqkekeddgrnvkllksgeiarwlvndmm<br>rfqpvqkdnegkpinnskansteyqmlqrslalynneekptryfrqvnliesnnphpflk<br>wtkweecnniltfyysyltkkieflnklkpedwkknqyflklkepktnretivqgwkngf<br>nlprgiftepirewfkrhqnnskeyekvealdrvglvtkviplffkeeyfkdkeenfked<br>tqkeindcvqpfynfpynvgnihkpekdflhreerielwdkkkdkfkgykekiksklt<br>ekdkeefrsylefqswnkferelrlvrnqdivtwllckelidklkidelnieeelkklri<br>nnidtdtakkeknnilnrvmpmelpvtvyeiddshkivkdkplhtiyikeaetkllkqgnf<br>kalvkdrringlfsfvktnseaeskrnpisklrveyelgeyqearieliqdmlaleekli<br>nkykdlptnkfsemlnswlegkdeadkarfqndvdfliavrnafshnqypmhnkiefani<br>kpfslytannseekglgianqlkdktkettdkikkiekpietke (SEQ ID NO:<br>606) |
| *Prevotella*<br>*pleuritidis*<br>F0068<br>NZ_AWET01000045.1)<br>>WP_021584635.1 | mendkrleesacytlndkhfwaaflnlarhnvyitvnhinktlelknkknqeiiidndqd<br>ilaikthwakvngdlnktdrlrelmikhfpfleaaiysnnkedkeevkeekqakaqsfks<br>lkdclflfleklqearnyyshykysesskepefeegllekmyntfdasirlvkedyqynk<br>didpekdfkhlerkedfnylftdkdnkgkitknglllffvslflekkdaiwmqqklngfkrgfkd<br>nrgnkekmthevfcrsrmllpkirlestqtqdwilldmlnelircpkslyerlqgayrek<br>fkvpfdsidedydaeqepfrntivrhqdrfpyfalryfdyneifknlrfqidlgtyhfsi<br>ykkliggkkedrhlthklygferigeftkqnrpdkwqaiikdldtyetsneryisettph<br>yhlenqkigirfrndnndiwpslktngeknekskynldkpyqaeaflsvhellpmmfyyl<br>llkmentdndkednevgtkkkgknknnkqekhkieeiienkikdiyalydaftngeinsid<br>elaegregkdieighlpkqlivilknkskdmaekanrkqkemikdtkkrlatldkqvkge<br>iedggrnirllksgeiarwlvndmmrfqpvqkdnegkpinnskansteyqmlqrslalyn<br>keekptryfrqvnlikssnphpfledtkweecynilsfyrnylkakikflnklkpedwkk<br>nqyflmlkepktnrktivqgwkngfnlprgiftepikewfkrhqndseeykkvealdrvg<br>lvakviplffkeeyfkedaqkeinncvqpfysfpynvgnihkpeeknflhceeerrklwdk<br>kkdkfkgykakekskkmtdkekeehrsylefqswnkferelrlvrnqdiltwllctklid<br>klkidelnieeelqklrlkdidtdtakkeknnilnrvmpmrlpvtvyeidksfnivdkpl<br>htvyieetgtkllkqgnfkalvkdrringlfsfvktssseaeskskpisklrveyelgayq<br>karidiikdmlalektlidndenlptnkfsdmlkswlkgkgeankarlqndvgllvavrn<br>afshnqypmynsevfkgmkllslssdipekeglgiakqlkdkiketieriieiekeirn<br>(SEQ ID NO: 607) |
| *Prevotella*<br>*pleuritidis*<br>JCM 14110<br>(NZ_BAJN01000005.1)<br>>WP_036931485.1 | mendkrleestcytlndkhfwaaflnlarhnvyitinhinkllleirgidndekvldikal<br>wqkvdkdinqkarlrelmikhfpfleaaiysnnkedkeevkeekqakaqsfkslkdclfl<br>fleklqearnyyshykssesskepefeegllekmyntfgvsirlvkedyqynkdidpekd<br>fkhlerkedfnylftdkdngllffvslflekkdaiwmqqklrgfkdnrgnkek<br>mthevfcrsrmllpkirlestqtqdwilldmlnelircpkslyerlqgayrekfkvpfds<br>idedydaeqepfrntivrhqdrfpyfalryfdyneifknlrfqidlgtyhfsiykkligd<br>nkedrhlthklygferigefakqkrpnewqalvkdldiyetsnegyisettphyhlenqk<br>igirfknkkdkiwpsletngkeneksykynldksfqaeaflsihellpmmfydlllkkeep<br>nndeknasivegfikkeikrmyaiydafaneeinskegleeyckncgfgerhlpkqmiai<br>ltnksknmaekakrkqkemikdtkkrlatldkqvkgeiedggrnirllksgeiarwlvnd<br>mmrfqsvqkdkegkpinnskansteyqmlqrslalynkeqkptpyfiqvnlikssnphpf<br>leetkweecnnilsfyrsyleaknfleslkpedwkknqyflmlkepktnrktivqgwkn<br>gfnlprgiftepikewfkrhqndseeykkvealdrvglvakviplffkeeyfkedaqkei |

TABLE 13-continued

| | |
|---|---|
| | nncvqpfysfpynvgnihkpeeknflhceerrklwdkkkdkfkgykakekskkmtdkeke ehrsylefqswnkferelrlvrnqdivtwllctelidklkidelnieelqklrlkdidtd takkeknnilnrimpmqlpvtvyeidksfnivdkdkplhtiyieetgtkllkqgnfkalvk drringlfsfvktsseaeskskpisklrveyelgayqkaridiikdmlalektlidnden lptnkfsdmlkswlkgkgeankarlqndvdllvairnafshnqypmynsevfkgmkllsl ssdipekeglgiakqlkdkiketieriieiekeirn (SEQ ID NO: 608) |
| *Prevotella falsenii* DSM 22864 = JO415124 NZ_BAJY01000004.1) >WP_036884929.1 | mkndnnstkstdytlgdkhfwaaflnlarhnvyitvnhinkvlelknkkdqeiiidndqd ilaiktlwgkvdtdinkkdrlrelimkhfpfleaatyqqsstnntkqkeeeqakaqsfes lkdclflfleklrearnyyshykhsksleepkleekllenmynifdtnvqlvikdyehnk dinpeedfkhlgraegefnyyftrnkkgnitesgllffvslflekkdaiwaqtkikgfkd nrenkqkmthevfcrsrmllpklrlestqtqdwilldmlnelircpkslykrlqgekrek frvpfdpadedydaeqepfkntivrhqdrfpyfalryfdyneiftnlrfqidlgtyhfsi ykkqigdkkedrhlthklygferigefakenrpdewkalvkdldtfeesnepyisettph yhlenqkigirnknkkkkktiwpsletkttvnerskynlgksfkaeaflsvhellpmmfy ylllnkeepnngkinaskvegiiekkirdiyklygafaneeinneeelkeycegkdiair hlpkqmiailkneykdmakkaedkqkkmikdtkkrlaaldkqvkgevedggrnikplksg riaswlvndmmrfqpvqrdrdgypinnskansteyqllqrtlalfgsererlapyfrqmn ligkdnphpflkdtkwkehnnilsfyrsyleakknflgslkpedwkknqyflklkepktn retivqgwkngfnlprgiftepirewfirhqneseeykkvkdfdriglvakviplffked yqkeiedyvqpfygypfnvgnihnsgegtflnkkereelwkgnktkfkdyktkeknkekt nkdkfkkktdeekeefrsyldfqswkkferelrlvrnqdivtwllcmelidklkidelni eelqklrlkdidtdtakkeknnilnrimpmelpvtvyetddsnniikdkplhtiyikeae tkllkqgnfkalvkdrringlfsfvetsseaelkskpiskslveyelgeyqrarveiikd mlrleetlignedklptnkfrqmldkwlehkketddtdlkndvklltevrnafshnqypm rdriafanikpfslssantsneeglgiakklkdktketidriieieeqtatkr (SEQ ID NO: 609) |
| *Porphyromonas gulae* NZ_JRAT01000012.1) >WP_039418912.1 | mteqserpyngtyytledkhfwaaflnlarhnayitlthidrqlayskaditndqdvlsf kalwknldndlerksrlrslilkhfsflegaaygkklfeskssgnkssknkeltkkekee lqanalsldnlksilfdflqklkdfrnyyshyrhsgsselplfdgnmlqrlynvfdvsvq rvkrdhehndkvdphrhfnhlvrkgkkdryghndnpsfkhhfvdsegmvteagllffvsl flekrdaiwmqkkirgfkggtetyqqmtnevfcrsrislplklkleslrmddwmlldmlne lvrcpkplydrlreddracfrvpvdilpdeddtdgggedpfkntivrhqdrfpyfalryf dlkkvftslrfhidlgtyhfaiykkmigeqpedrhltrnlygfgriqdfaeehrpeewkr lvrdldyfetgdkpyisqtsphyhiekgkiglrfmpegqhlwpspevgttrtgrskyaqd krltaeaflsvhelmpmmfyyfllrekyseevsaekvqgirikrviedvyaiydafardei ntlkeldacladkgirrghlpkqmiailsgehknmeekvrkklqemiadtdhrldmldrq tdrkirigrknaglpksgviadwlvrdmmrfqpvakdasgkpinnskansteyrmlqral alfggekerltpyfrqmnitggnnphpflhdtrweshtnilsfyrsylrarkaflerigr sdrmenrpflllkepktdrqtivagwkseflhprgifteavrdcliemgydevgsyrevg fmakavplyferacedrvqpfydspfnvgnslkpkkgrflskeeraeewergkerfrdle awshsaarriedafagieyaspgnkkkieqllrdlslweafesklkvradkinlaklkke ileagehpyhdfkswqkferelrlvknqdiitwmmcrdlmeenkvegldtgtlylkdirt nvqeqgslnvinhvkpmrlpvvvyradsrghvhkeeaplatvvyieerdtkllkqgnfksf vkdrringlfsfvdtgglamegypisklrveyelakyqtarvcafeqtleleesllstryp hlpdknfrkmleswsdpllakwpelhgkvrlliavrnafshnqypmydeavfssirkydp sspdaieermglniahrlseevkqaketveriiqa (SEQ ID NO: 610) |
| *Porphyromonas sp.* COT-052 OH4946 (NZ_JQZY01000014.1) >WP_039428968.1 | mteqserpyngtyytledkhfwaaflnlarhnayitlthidrqlayskaditndqdvlsf kalwknfdndlerksrlrslilkhfsflegaaygkklfeskssgnkssknkeltkkekee lqanalsldnlksilfdflqklkdfrnyyshyrhsesselplfdgnmlqrlynvfdvsvq rvkrdhehndkvdphrhfnhlvrkgkkdryghndnpsfkhhfvdsegmvteagllffvsl flekrdaiwmqkkirgfkggtetyqqmtnevfcrsrislplklkleslrmddwmlldmlne lvrcpkplydrlreddracfrvpvdilpdeddtdgggedpfkntivrhqdrfpyfalryf dlkkvftslrfhidlgtyhfaiykkmigeqpedrhltrnlygfgriqdfaeehrpeewkr lvrdldyfetgdkpyisqttphyhiekgkiglrfvpegqhlwpspevgttrtgrskyaqd krltaeaflsvhelmpmmfyyfllrekyseevsaekvqgirikrviedvyaiydafardei ntlkeldacladkgirrghlpkqmigilsgerkdmeekvrkklqemiadtdhrldmldrq tdrkirigrknaglpksgviadwlvrdmmrfqpvakdtsgkpinnskansteyrmlqral alfggekerltpyfrqmnitggnnphpflhetrweshtnilsfyrsylrarkaflerigr sdrvencpflllkepktdrqtivagwkgeflhprgifteavrdcliemgydevgsyrevg fmakavplyferacedrvqpfydspfnvgnslkpkkgrflskedraeewergkerfrdle awshsaarrikdafagieyaspgnkkkieqllrdlslweafesklkvradkinlaklkke ileagehpyhdfkswqkferelrlvknqdiitwmmcrdlmeenkvegldtgtlylkdirp nvqeqgslnvinrvkpmrlpvvvyradsrghvhkeeaplatvvyieerdtkllkqgnfksf vkdrringlfsfvdtgglamegypisklrveyelakyqtarvcvfeltlrleesllsryp hlpdesfremleswsdpllakwpelhgkvrlliavrnafshnqypmydeavfssirkydp sspdaieermglniahrlseevkqaketveriiqa (SEQ ID NO: 611) |
| *Porphyromonas gulae* (NZ_JRFD01000046.1) >WP_039442171A | mteqserpyngtyytledkhfwaaflnlarhnayitlthidrqlayskaditndqdvlsf kalwknldndlerksrlrslilkhfsflegaaygkklfeskssgnkssknkeltkkekee lqanalsldnlksilfdflqklkdfrnyyshyrhsgsselplfdgnmlqrlynvfdvsvq rvkrdhehndkvdphyhfnhlvrkgkkdryghndnpsfkhhfvdsegmvteagllffvsl flekrdaiwmqkkirgfkggtpyeqmtnevfcrsrislplklkleslrtddwmlldmlne lvrcpkplydrlrekdracfrvpvdilpdeddtdgggedpfkntivrhqdrfpyfalryf dlkkvftslrfhidlgtyhfaiykkmigeqpedrhltrnlygfgriqdfaeehrpeewkr lvrdldyletgdkpyisqttphyhiekgkiglrfvpegqhlwpspevgttrtgrskcaqd krltaeaflsvhelmpmmfyyfllrekyseevsaekvqgirikrviedvyaiydafardei ntlkeldtcladkgirrghlpkqmitilsgerkdmkekirkklqemiadtdhrldmldrq |

TABLE 13-continued

| | |
|---|---|
| | tdrkirigrknaglpksgviadwlvrdmmrfqpvakdasgkpinnskansteyrmlqral<br>alfggekerltpyfrqmnitggnnphpflhetrweshtnilsfyrsylrarkaflerigr<br>sdrvencpflllkepktdrqtivagwkdefhlprgifteavrdcliemgydevgsyrevg<br>fmakavplyferacedrvqpfydspfnvgnslkpkkgrflskedraeewergmerfrdle<br>awshsaarrikdafagieyaspgnkkkieqllrdlslweafesklkvradkinlaklkke<br>ileagehpyhdfkswqkferelrlvknqdiitwmmcrdlmeenkvegldtgtlylkdirp<br>nvqeeqgslnvinrvkpmrlpvvvyradsrghvhkeaplatvyieerntkllkqgnfksfv<br>kdrringlfsfvdtgglamegypisklrveyelakyqtarvcvfeltlrleesllsryph<br>lpdesfremleswsdpllakwpelhgkvrlliavrnafshnqypmydeavfssirkydps<br>spdaieermglniahrlseevkqaketveriiqa (SEQ ID NO: 612) |
| *Porphyromonas gulae*<br>(NZ_JRAJ01000010.1)<br>>WP_039431778A | mteqserpyngtyytledkhfwaaflnlarhnayitlthidrqlayskaditndqdvlsf<br>kalwknfdndlerksrlrslilkhfsflegaaygkklfeskssgnkssknkeltkkekee<br>lqanalsldnlksilfdflqklkdfrnyyshyrhsesselplfdgnmlqrlynvfdvsvq<br>rvkrdhehndkvdphrhfnhlvrkgkkdryghndnpsfkhhfvdgegmvteagllffvsl<br>flekrdaiwmqkkirgfkggtetyqqmtnevfcrsrislpklkleslrtddwmlldmlne<br>lvrcpkplydrlreddacfrvpvdilpdeddtdgggedpfkntivrhqdrfpyfalryf<br>dlkkvftslrfhidlgtyhfaiykkmigeqpedrhltrnlygfgriqdfaeehrpeewkr<br>lvrdldyfetgdkpyisqtsphyhiekgkiglrfmpegqhlwpspevgttrtgrskyaqd<br>krltaeaflsvhelmpmmfyyfllrekyseevsaekvqgirkrviedvyaiydafardei<br>ntlkeldacladkgirrghlpkqmiailsgehkdmeekirkklqemiadtdhrldmldrq<br>tdrkirigrknaglpksgviadwlvrdmmrfqpvakdtsgkpinnskansteyrmlqral<br>alfggekkrltpyfrqmnitggnnphpflhetrweshtnilsfyrsylrarkaflerigr<br>sdrmenrpflllkepktdrqtivagwksefhlprgifteavrdcliemgydevgsyrevg<br>fmakavplyferacedrvqpfydspfnvgnslkpkkgrflskeeraeewergkerfrdle<br>awshsaarriedafagieyaspgnkkkieqllrdlslweafesklkvradkinlaklkke<br>ileagehpyhdfkswqkferelrlvknqdiitwmmcrdlmeenkvegldtgtlylkdirp<br>nvqeeqgslnvinrvkpmrlpvvvyradsrghvhkeeaplatvyieerdtkllkqgnfksf<br>vkdrringlfsfvdtgglamegypisklrveyelakyqtarvcvfeltlrleeslltryp<br>hlpdesfrkmleswsdpllakwpelhgkvrlliavrnafshnqypmydeavfssirkydp<br>sspdaieermglniahrlseevkqaketveriiqv (SEQ ID NO: 613) |
| *Porphyromonas gulae*<br>(NZ_KQ040500.1)<br>>WP_046201018A | mteqserpyngtyytledkhfwaaflnlarhnayitlthidrqlayskaditndqdvlsf<br>kalwknfdndlerksrlrslilkhfsflegaaygkklfeskssgnkssknkeltkkekee<br>lqanalsldnlksilfdflqklkdfrnyyshyrhsesselplfdgnmlqrlynvfdvsvq<br>rvkrdhehndkvdphrhfnhlvrkgkkdryghndnpsfkhhfvdsegmvteagllffvsl<br>flekrdaiwmqkkirgfkggtetyqqmtnevfcrsrislpklkleslrtddwmlldmlne<br>lvrcpkplydrlekdrarfrvpvdilpdeddtdgggedpfkntivrhqdrfpyfalryf<br>dlkkvftslrfhidlgtyhfaiykkmigeqpedrhltrnlygfgriqdfaeehrpeewkr<br>lvrdldyfetgdkpyisqttphyhiekgkiglrfmpegqhlwpspevgttrtgrskyaqd<br>krltaeaflsvhelmpmmfyyfllrekyseevsaekvqgirkrviedvyaiydafardei<br>ntlkeldacladkgirrghlpkqmiailsgehkdmeekirkklqemiadtdhrldmldrq<br>tdrkirigrknaglpksgviadwlvrdmmrfqpvakdtsgkpinnskansteyrmlqral<br>alfggekkrltpyfrqmnitggnnphpflhetrweshtnilsfyrsylrarkaflerigr<br>sdrmenrpflllkepktdrqtivagwksefhlprgifteavrdcliemgydevgsyrevg<br>fmakavplyferacedrvqpfydspfnvgnslkpkkgrflskeeraeewergkerfrdle<br>awshsaarriedafagieyaspgnkkkieqllrdlslweafesklkvradkinlaklkke<br>ileagehpyhdfkswqkferelrlvknqdiitwmmcrdlmeenkvegldtgtlylkdirp<br>nvqeeqgslnvinrvkpmrlpvvvyradsrghvhkeeaplatvyieerdtkllkqgnfksf<br>vkdrringlfsfvdtgglamegypisklrveyelakyqtarvcvfeltlrleeslltryp<br>hlpdesfrkmleswsdpllakwpelhgkvrlliavrnafshnqypmydeavfssirkydp<br>sspdaieermglniahrlseevkqaketveriiqv (SEQ ID NO: 614) |
| *Porphyromonas gulae*<br>(NZ_JRAL01000022.1)<br>>WP_039434803.1 | mteqserpyngtyytledkhfwaaflnlarhnayitlthidrqlayskaditndqdvlsf<br>kalwknfdndlerksrlrslilkhfsflegaaygkklfeskssgnkssknkeltkkekee<br>lqanalsldnlksilfdflqklkdfrnyyshyrhsgsselplfdgnmlqrlynvfdvsvq<br>rvkidhehndevdphyhfnhlvrkgkkdryghndnpsfkhhfvdgegmvteagllffvsl<br>flekrdaiwmqkkirgfkggtetyqqmtnevfcrsrislpklkleslrmddwmlldmlne<br>lvrcpkplydrlreddacfrvpvdilpdeddtdgggdpfkntivrhqdrfpyfalryf<br>dlkkvftslrfhidlgtyhfaiykkmigeqpedrhltrnlygfgriqdfaeehrpeewkr<br>lvrdldyfetgdkpyisqtsphyhiekgkiglrfmpegqhlwpspevgttrtgrskyaqd<br>krltaeaflsvhelmpmmfyyfllrekyseevsaervqgirkrviedvyavydafardei<br>ntrdeldacladkgirrghlprqmiailsgehkdmeekirkklqemmadtdhrldmldrq<br>tdrkirigrknaglpksgviadwlvrdmmrfqpvakdasgkpinnskansteyrmlqral<br>alfggekerltpyfrqmnitggnnphpflhetrweshtnilsfyrsylrarkaflerigr<br>sdrvenrpflllkepktdrqtivagwkdefhlprgifteavrdcliemghdevasykevg<br>fmakavplyferacedrvqpfydspfnvgnslkpkkgrflskeeraeewergkerfrdle<br>awsysaarriedafagieyaspgnkkkieqllrdlslweafesklkvradrinlaklkke<br>ileagehpyhdfkswqkferelrlvknqdiitwmmcrdlmeenkvegldtgtlylkdirp<br>nvqeeqgslnvinrvkpmrlpvvvyradsrghvhkeeaplatvyieerdtkllkqgnfksf<br>vkdrringlfsfvdtgglamegypisklrveyelakyqtarvcvfeltlrleeslltryp<br>hlpdesfremleswsdpllakwpelhgkvrlliavrnafshnqypmydeavfssirkydp<br>sspdaieermglniahrlseevkqaketveriiqa (SEQ ID NO: 615) |
| *Porphyromonas gulae*<br>(NZ_JRAI01000002.1)<br>>WP_039419792.1 | mteqserpyngtyytledkhfwaaflnlarhnayitlthidrqlayskaditndqdvlsf<br>kalwknldndlerksrlrslilkhfsflegaaygkklfeskssgnkssknkeltkkekee<br>lqanalsldnlksilfdflqklkdfrnyyshyrhsgsselplfdgnmlqrlynvfdvsvq<br>rvkrdhehndkvdphrhfnhlvrkgkkdryghndnpsfkhhfvdgegmvteagllffvsl<br>flekrdaiwmqkkirgfkggtetyqqmtnevfcrsrislpklkleslrtddwmlldmlne<br>lvrcpkplydrlekdrarfrvpvdilpdeddtdgggedpfkntivrhqdrfpyfalryf |

TABLE 13-continued

| | |
|---|---|
| | dlkkvftslrfhidlgtyhfaiykkvigeqpedrhltrnlygfgriqdfaeehrpeewkr<br>lvrdldyfetgdkpyisqttphyhiekgkiglrfvpegqhlwpspevgttrtgrskyaqd<br>krltaeaflsvhelmpmmfyyfllrekyseevsaekvqgrikrviedvyaiydafardei<br>ntrdeldacladkgirrghlpkqmigilsgehknmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpfldetrweshtnilsfyrsylrarkaflerigr<br>sdrvenrpfllkepktdrqtivagwksefhlprgifteavrdcliemgydevgsykevg<br>fmakavplyferackdrvqpfydspfnvgnslkpkkgrflskekraeewesgkerfrlak<br>lkkeileagehpyhdfkswqkferelrlvknqdiitwmmcrdlmeenkvegldtgtlylk<br>dirpnvqeqgslnvinrvkpmrlpvvvyradsrghvhkeeaplatvyieerdtkllkqgn<br>fksfvkdrringlfsfvdtgglamegypisklrveyelakyqtarvcvfeltlrleesll<br>sryphlpdesfremleswsdpllakwpelhgkvrlliavrnafshnqypmydeavfssir<br>kydpsspdaieermglniahrlseevkqaketveriiqa (SEQ ID NO: 616) |
| *Porphyromonas gulae*<br>(NZ_JRAK01000129.1)<br>>WP_039426176.1 | mteqserpyngtyytledkhfwaaflnlarhnayitlthidrqlayskaditndqdvlsf<br>kalwknfdndlerksrlrslilkhfsflegaaygkklfeskssgnkssknkeltkkekee<br>lqanalsldnlksilfdflqklkdfrnyyshyrhsgsselplfdgnmlqrlynvfdvsvq<br>rvkrdhehndkvdphyhfnhlvrkgkkdryghndnpsfkhhfvdsegmvteaglffvsl<br>flekrdaiwmqkkirgfkggtgpyeqmtnevfcrsrislpklkleslrtddwmlldmlne<br>lvrcpkplydrlrekdracfrvpvdilpdeddtdgggedpfkntivrhqdrfpyfalryf<br>dlkkvftslrfhidlgtyhfaiykkmigeqpedrhltrnlygfgriqdfaeehrpeewkr<br>lvrdldyfetgdkpyisqttphyhiekgkiglrfmpegqhlwpspevgttrtgrskyaqd<br>krltaeaflsvhelmpmmfyyfllrekyseevsaekvqgrikrvikdvyaiydafardei<br>ntlkeldacsadkgirrghlpkqmigilsgehknmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpfldetrweshtnilsfyrsylrarkaflerigr<br>sdrvenrpflllkepkndrqtivagwksefhlprgifteavrdcliemgydevgsykevg<br>fmakavplyferackdrvqpfydspfnvgnslkpkkgrflskekraeewesgkerfrlak<br>lkkeileakehpyhdfkswqkferelrlvknqdiitwmmcrdlmeenkvegldtgtlylk<br>dirtdvheqgslnvinrvkpmrlpvvvyradsrghvhkeqaplatvyieerdtkllkqgn<br>fksfvkdrringlfsfvdtgglamegypisklrveyelakyqtarvcafeqtleleesll<br>tryphlpdenfremleswsdpllgkwpdlhgkvrlliavrnafshnqypmydeavfssir<br>kydpsspdaieermglniahrlseevkqaketveriiqa (SEQ ID NO: 617) |
| *Porphyromonas gulae*<br>(NZ_KN294104.1)<br>>WP_039437199.1 | mteqserpyngtyytledkhfwaaflnlarhnayitlthidrqlayskaditndededilff<br>kgqwknldndlerksrlrslilkhfsflegaaygkkffeskssgnkssknkeltkkekee<br>lqanalsldnlksilfdflqklkdfrnyyshyrhsgsselplfdgnmlqrlynvfdvsvq<br>rvkrdhehndevdphyhfnhlvrkgkkdryghndnpsfkhhfvdsegmvteaglffvsl<br>flekrdaiwmqkkirgfkggtepyeqmtnevfcrsrislpklkleslrtddwmlldmlne<br>lvrcpkplydrlrekdracfrvpvdilpdeddtdgggedpfkntivrhqdrfpyfalryf<br>dlkkvftslrfhidlgtyhfaiykkmigeqpedrhltrnlygfgriqdfaeehrpeewkr<br>lvrdldyfetgdkpyisqttphyhiekgkiglrfvpegqhlwpspevgttrtgrskyaqd<br>krltaeaflsvhelmpmmfyyfllrekyseevsaekvqgrikrviedvyaiydafardei<br>ntlkeldacladkgirrghlpkqmigilsgerkdmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylrarkaflerigr<br>sdrvencpflllkepktdrqtivagwkgefhlprgifteavrdcliemgydevgsyrevg<br>fmakavplyferacedrvqpfydspfnvgnslkpkkgrflskekraeewesgkerfrlak<br>lkkeileagehpyhdfkswqkferelrlvknqdiitwmmcrdlmeenkvegldtgtlylk<br>dirpnvqeqgslnvinrvkpmrlpvvvyradsrghvhkeeaplatvyieerdtkllkqgn<br>fksfvkdrringlfsfvdtgalamegypisklrveyelakyqtarvcafeqtleleesll<br>tryphlpdesfremleswsdplltkwpelhgkvrlliavrnafshnqypmydeavfssiw<br>kydpsspdaieermglniahrlseevkqaketieriiqa (SEQ ID NO: 618) |
| *Porphyromonas gingivalis* TDC60<br>(NC_015571.1)<br>>WP_013816155.1 | mtegnekpyngtyytledkhfwaaffnlarhnayitlahidrqlayskaditndededilff<br>kgqwknldndlerkarlrslilkhfsflegaaygkklfesqssgnkssknkeltkkekee<br>lqanalsldnlksilfdflqklkdfrnyyshyrhpesselplfdgnmlqrlynvfdvsvq<br>rvkrdhehndkvdphrhfnhlvrkgkkdrygnndnpffkhhfvdregtvteaglffvsl<br>flekrdaiwmqkkirgfkggtetyqqmtnevfcrsrislpklkleslrtddwmlldmlne<br>lvrcpkslydrlreedrarfrvpvdilsdeedtdgaeedpfkntivrhqdrfpyfalryf<br>dlkkvftslrfqidlgtyhfaiykkniggeqpedrhltrnlygfgriqdfaeehrpeewkr<br>lvrdldyfetgdkpyitqttphyhiekgkiglrfvpegqhlwpspevgatrtgrskyaqd<br>krftaeaflsahelmpmmfyyfllrekydeeasaervqgrikrviedvyavydafardei<br>ntrdeldacladkgirrghlprqmigilsgehkdmeekirkklqemmadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdrvenhrflllkepktdrqtliemgwkgefhlprgifteavrdcliemgldevgsykevg<br>fmakavplyferackdwvqpfynypfnvgnslkpkkgrflskekraeewesgkerfrlak<br>lkkeileakehpyldfkswqkferelrlvknqdiitwmicgdlmeenkvegldtgtlylk<br>dirtdvqeqgslnvinrvkpmrlpvvvyradsrghvhkeqaplatvyieerdtkllkqgn<br>fksfvkdrringlfsfvdtgalamegypisklrveyelakyqtarvcafeqtleleesll<br>trcphlpdknfrkmleswsdplldkwpdlhrkvrlliavrnafshnqypmydeavfssir<br>kydpsfpdaieermglniahrlseevkqaketveriiqa (SEQ ID NO: 619) |
| *Porphyromonas gingivalis* ATCC 33277<br>(NC_010729.1)<br>>WP_012458414.1 | mtegnerpyngtyytledkhfwaaffnlarhnayitlahidrqlayskaditndededilff<br>kgqwknldndlerkarlrslilkhfsflegaaygkklfesqssgnksskkkeltkkekee<br>lqanalsldnlksilfdflqklkdfrnyyshyrhpesselplfdgnmlqrlynvfdvsvq<br>rvkrdhehndkvdphrhfnhlvrkgkkdrygnndnpffkhhfvdreekvteaglffvsl<br>flekrdaiwmqkkirgfkggtetyqqmtnevfcrsrislpklkleslrtddwmlldmlne<br>lvrcpkslydrlreedrarfrvpvdilsdeddtdgteedpfkntivrhqdrfpyfalryf |

TABLE 13-continued

| | |
|---|---|
| | dlkkvftslrfhidlgtyhfaiykknigeqpedrhltrnlygfgriqdfaeehrpeewkr<br>lvrdldyfetgdkpyitqttphyhiekgkiglrfvpegghlwspevgatrtgrskyaqd<br>krltaeaflsvhelmpmmfyyfllrekysdeasaervqgirkrviedvyavydafargei<br>ntrdeldacladkgirrghlprqmigilsgehkdmeekvrkklqemivdtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdrvenhrflllkepktdrqtivagwkgefhlprgifteavrdcliemgldevgsykevg<br>fmakavplyferackdrvqpfydypfnvgnslkpkkgrflskekraeeewesgkerfrlak<br>lkkeileakehpyldfkswqkferelrlvknqdiitwmicrdlmeenkvegldtgtlylk<br>dirtdvqeqgninvinrvkpmrlpvvvyradsrghvhkeqaplatvyieerdtkllkqgn<br>fksfvkdrringlfsfvdtgalamegypisklrveyelakyqtarvcafeqtleleesll<br>tryphlpdknfrkmleswsdplldkwpdlhgnvrlliavrnafshnqypmydeavfssir<br>kydpsspdaieermglniahrlseevkqakemaeriiqa (SEQ ID NO: 620) |
| Porphyromonas<br>gingivalis<br>A7A1-28<br>(NZCP013131.1)<br>>WP_058019250.1 | mtegnekpyngtyytlkdkhfwaaffnlarhnayitlthidrqlayskaditndedilff<br>kgqwknldndlerkarlrslilkhfsflegaaygkklfesqssgnksskkkeltkkekee<br>lqanalsldnlksilfdflqklkdfrnyyshyrhpesselpmfdgnmlqrlynvfdvsvq<br>rvkrdhehndkvdphrhfnhlvrkgkkdrcgnndnpffkhhfvdregkvteagllffvsl<br>flekrdaiwmqkkirgfkggtetyqqmtnevfcrsrislpklkleslrtddwmlldmlne<br>lvrcpkslydrlreedracfrvpvdilsdeddtdgaeedpfkntivrhqdrfpyfalryf<br>dlkkvftslrfhidlgtyhfaiykknigeqpedrhltrnlygfgriqdfaeehrpeewkr<br>lvrdldcfetgdkpyitqttphyhiekgkiglrfvpegghlwspevgatrtgrskyaqd<br>krftaeaflsvhelmpmmfyyfllrekyseevsaervqgirkrviedvyavydafardei<br>ntrdeldacladkgirrghlprqmiailsqkhkdmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdrvenhrflllkepktdrqtivagwkgefhlprgifteavrdcliemgldevgsykevg<br>fmakavplyferackdrvqpfydypfnvgnslkpkkgrflskekraeeewesgkerfrdle<br>awshsaarriedafagienasrenkkkieqllqdlslwetfesklkvkadkiniaklkke<br>ileakehpyldfkswqkferelrlvknqdiitwmcrdlmeenkvegldtgtlylkdirt<br>dvqeqgslnvinhvkpmrlpvvvyradsrghvhkeqaplatvyieerdtkllkqgnfksf<br>vkdrringlfsfvdtgalamegypisklrveyelakyqtarvcafeqtleleeslltryp<br>hlpdenfrkmleswsdplldkwpdlhrkvrlliavrnafshnqypmydeavfssirkydp<br>sspdaieermglniahrlseevkqakemaeriiqa (SEQ ID NO: 621) |
| Porphyromonas<br>gingivalis<br>JCVI SC001<br>APMB01000175.1)<br>>EOA10535.1 | mtegnekpyngtyytledkhfwaaffnlarhnayitlthidrqlayskaditndedilff<br>kgqwknldndlerkarlrslilkhfsflegaaygkklfesqssgnksskkkeltkkekee<br>lqanalsldnlksilfdflqklkdfrnyyshyrhpesselplfdgnmlqrlynvfdvsvq<br>rvkrdhehndkvdphrhfnhlvrkgkkdrcgnndnpffkhhfvdreekvteagllffvsl<br>flekrdaiwmqkkirgfkggtetyqqmtnevfcrsrislpklkleslrtddwmlldmlne<br>lvrcpkslydrlreedrarfrvpvdilsdeddtdgteedpfkntivrhqdrfpyfalryf<br>dlkkvftslrfhidlgtyhfaiykknigeqpedrhltrnlygfgriqdfaeehrpeewkr<br>lvrdldyfetgdkpyitqttphyhiekgkiglrfvpegqllwspevgatrtgrskyaqd<br>krftaeaflsvhelmpmmfyyfllrekyseeasaervqgirkrviedvyavydafargei<br>dtldrldacladkgirrghlprqmiailsgehkdmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdrvenhrflllkepktdrqtivagwkgefhlprgifteavrdcliemgldevgsykevg<br>fmakavplyferackdrvqpfydypfnvgnslkpkkgrflskekraeeewesgkerfrdle<br>awshsaarriedafagienasrenkkkieqllqdlslwetfesklkvkadkiniaklkke<br>ileakehpyldfkswqkferelrlvknqdiitwmcrdlmeenkvegldtgtlylkdirt<br>dvheqgslnvinrvkpmrlpvvvyradsrghvhkeqaplatvyieerdtkllkqgnfksf<br>vkdrringlfsfvdtgalamegypisklrveyelakyqtarvcafeqtleleeslltryp<br>hlpdknfrkmleswsdplldkwpdlhgnvrlliavrnafshnqypmydetlfssirkydp<br>sspdaieermglniahrlseevkqakemveriiqa (SEQ ID NO: 622) |
| Porphyromonas<br>gingivalis W50<br>(NZ_AJZS01000051.1)<br>>WP_005874195.1 | mtegnekpyngtyytledkhfwaaffnlarhnayitlahidrqlayskaditndedilff<br>kgqwknldndlerkarlrslilkhfsflegaaygkklfesqssgnksskkkeltkkekee<br>lqanalsldnlksilfdflqklkdfrnyyshyrhpesselplfdgnmlqrlynvfdvsvq<br>rvkrdhehndkvdphrhfnhlvrkgkkdkygnndnpffkhhfvdreekvteagllffvsl<br>flekrdaiwmqkkirgfkggteayqqmtnevfcrsrislpklkleslrtddwmlldmlne<br>lvrcpkslydrlreedrarfrvpvdilsdeddtdgteedpfkntivrhqdrfpyfalryf<br>dlkkvftslrfhidlgtyhfaiykknigeqpedrhltrnlygfgriqdfaeehrpeewkr<br>lvrdldyfetgdkpyitqttphyhiekgkiglrfvpegqllwspevgatrtgrskyaqd<br>krftaeaflsvhelmpmmfyyfllrekyseeasaekvqgirkrviedvyavydafardei<br>ntrdeldacladkgirrghlprqmiailsgehkdmeekvrkklqemiadtdhrldmldrq<br>tdrkirigrknaglpksgviadwlvrdmmrfqpvakdtsgkpinnskansteyrmlqral<br>alfggekerltpyfrqmnitggnnphpflhetrweshtnilsfyrsylkarkaflqsigr<br>sdreenhrflllkepktdrqtivagwksefhlprgifteavrdcliemgydevgsykevg<br>fmakavplyferackdrvqpfydypfnvgnslkpkkgrflskekraeeewesgkerfrdle<br>awshsaarriedafvgieyaswenkkkieqllqdlslwetfesklkvkadkiniaklkke<br>ileakehpyhdfkswqkferelrlvknqdiitwmcrdlmeenkvegldtgtlylkdirt<br>dvqeqgslnvinhvkpmrlpvvvyradsrghvhkeeaplatvyieerdtkllkqgnfksf<br>vkdrringlfsfvdtgalamegypisklrveyelakyqtarvcafeqtleleeslltryp<br>hlpdesfremleswsdplldkwpdlqrevrlliavrnafshnqypmydetifssirkydp<br>ssldaieermglniahrlseevklakemveriiqa (SEQ ID NO: 623) |

TABLE 13-continued

| | |
|---|---|
| Porphyromonas gingivalis (NZ_CP011995.1) >WP_052912312.1 | mtegnekpyngtyytledkhfwaaffnlarhnayitlahidrqlayskaditndedilff kgqwknldndlerkarlrslilkhfsflegaaygkklfesqssgnksskkkeltkkekee lqanalsldnlksilfdflqklkdfrnyyshyrhpesselplfdgnmlqrlynvfdvsvq rvkrdhehndkvdphrhfnhlvrkgkkdkygnnndnpffkhhfvdreekvteagllffvsl flekrdaiwmqkkirgfkggteayqqmtnevfcrsrislpklkleslrtddwmlldmlne lvrcpkllydrlreedrarfrvpvdilsdeddtdgteedpfkntivrhqdrfpyfalryf dlkkvftslrfhidlgtyhfaiykknigeqpedrhltrnlygfgriqdfaeehrpeewkr lvrdldyfetgdkpyitqttphyhiekgkiglrfvpegqhlwpspevgatrtgrskyaqd krftaeaflsvhelmpmmfyyfllrekyseeasaekvqgrikrviedvyavydafardei ntrdeldacladkgirrghlprqmiailsgehkdmeekvrkklqemiadtdhrldmldrq tdrkirigrknaglpksgviadwlvrdmmrfqpvakdtsgkpinnskansteyrmlqral alfggekerltpyfrqmnitgnnphpflhetrweshtnilsfyrsylkarkaflqsigr sdreenhrflllkepktdrqtivagwksefhlprgifteavrdcliemgydevgsykevg fmakavplyferackdrvqpfydypfnvgnslkpkkgrflskekraeewesgkerfrdle awshsaarriedafvgieyaswenkkkieqllqdlslwetfesklkvkadkiniaklkke ileakehpyhdfkswqkferelrlvknqdiitwmmcrdlmeenkvegldtgtlylkdirt dvqeqgslnvinhvkpmrlpvvvyradsrghvhkeeaplatvyieerdtkllkqgnfksf vkdrringlfsfvdtgalamegypisklrveyelakyqtarvcafeqtleleesslltryp hlpdesfremleswsdplldkwpdlqrevrlliavrnafshnqypmydetifssirkydp ssldaieermglniahrlseevklakemveriiqa (SEQ ID NO: 624) |
| Porphyromonas gingivalis AJW4 (NZ_CP011996.1) >WP_053444417.1 | mtegnekpyngtyytledkhfwaaffnlarhnayitlahidrqlayskaditndedilff kgqwknldndlerkarlrslilkhfsflegaaygkklfesqssgnksskkkelskkekee lqanalsldnlksilfdflqklkdfrnyyshyrhpesselplfdgnmlqrlynvfdvsvq rvkrdhehndkvdphrhfnhlvrkgkkdkygnnndnpffkhhfvdregtvteagllffvsl flekrdaiwmqkkirgfkggteayqqmtnevfcrsrislpklkleslrtddwmlldmlne lvrcpkslydrlreedrarfrvpvdilsdeddtdgteedpfkntivrhqdrfpyfalryf dlkkvftslrfhidlgtyhfaiykknigeqpedrhltrnlygfgriqdfaeehrpeewkr lvrdldyfetgdkpyitqttphyhiekgkiglrfvpegqhlwpspevgatrtgrskyaqd krltaeaflsvhelmpmmfyyfllrekyseevsaekvqgrikrviedvyavydafardei ntrdeldacladkgirrghlprqmiailsgehkdmeekvrkklqemiadtdhrldmldrq tdrkirigrknaglpksgvvadwlvrdmmrfqpvakdtsgkpinnskansteyrmlqral alfggekerltpyfrqmnitggnnphpflhetrweshtnilsfyrsylearkaflqsigr sdrvenhrflllkepktdrqtivagwksefhlprgifteavrdcliemgydevgsykevg fmakavplyferaskdrvqpfydypfnvgnslkpkkgrflskekraeewesgkerfrlak lkkeileakehpyhdfkswqkferelrlvknqdiitwmmcrdlmeenkvegldtgtlylk dirtdvqeqgslnvinrvkpmrlpvvvyradsrghvhkeqaplatvyieerdtkllkqgn fksfvkdrringlfsfvdtgalamegypisklrveyelakyqtarvcafeqtleleesll tryphlpdknfrkmleswsdplldkwpdlhgnvrlliavrnafshnqypmydetlfssir kydpsspdaieermglniahrlseevkqakemveriiqa (SEQ ID NO: 625) |
| Porphyromonas gingivalis (NZ_CP007756.1) >WP_039417390.1 | mtegnerpyngtyytledkhfwaaffnlarhnayitlahidrqlayskaditndedilff kgqwknldndlerkarlrslilkhfsflegaaygkklfesqssgnksskkkeltkkekee lqanalsldnlksilfdflqklkdfrnyyshyrhpesselplfdgnmlqrlynvfdvsvq rvkrdhehndkvdphrhfnhlvrkgkkdkrygnnndnpffkhhfvdregtvteagllffvsl flekrdaiwmqkkirgfkggteayqqmtnevfcrsrislpklkleslrtddwmlldmlne lvrcpkslydrlreedrarfrvpidilsdeddtdgteedpfkntivrhqdrfpyfalryf dlkkvftslrfhidlgtyhfaiykknigeqpedrhltrnlygfgriqdfaeehrpeewkr lvrdldyfetgdkpyitqttphyhiekgkiglrfvpegqhlwpspevgatrtgrskyaqd krltaeaflsvhelmpmmfyyfllrekyseevsaekvqgrikrviedvyavydafargei dtldrldacladkgirrghlprqmiailsgehkdmeekvrkklqemiadthrldmldrq tdrkirigrknaglpksgviadwlvrdmmrfqpvakdtsgkpinnskansteyrmlqral alfggekerltpyfrqmnitggnnphpflhetrweshtnilsfyrsylkarkaflqsigr sdreenhrflllkepktdrqtivagwksefhlprgifteavrdcliemgydevgsykevg fmakavplyferackdrvqpfydypfnvgnslkpkkgrflskekraeewesgkerfrlak lkkeileakehpyldfkswqkferelrlvknqdiitwmmcrdlmeenkvegldtgtlylk dirtdvheqgslnvinrvkpmrlpvvvyradsrghvhkeqaplatvyieerdtkllkqgn fksfvkdrringlfsfvdtgalamegypisklrveyelakyqtarvcafeqtleleesll tryphlpdknfrkmleswsdplldkwpdlhrkvrlliavrnafshnqypmydeavfssir kydpsspdaieermglniahrlseevkqakemaeriiqv (SEQ ID NO: 626) |
| Porphyromonas gingivalis (NZ_LOEL01000001.1) >WP_061156470.1 | mtegnerpyngtyytledkhfwaaffnlarhnayitlthidrqlayskaditndedilff kgqwknldndlerkarlrslilkhfsflegaaygkklfenkssgnksskkkeltkkekee lqanalsldnlksilfdflqklkdfrnyyshyrhpesselplfdgnmlqrlynvfdvsvq rvkrdhehndkvdphrhfnhlvrkgkkdrcgnnndnpffkhhfvdregkvteagllffvsl flekrdaiwmqkkirgfkggteayqqmtnevfcrsrislpklkleslrtddwmlldmlne lvrcpkslydrlreedrarfrvpvdilsdeddtdgteedpfkntivrhqdrfpyfalryf dlkkvftslrfhidlgtyhfaiykknigeqpedrhltrnlygfgriqdfaeehrpeewkr lvrdldyfetgdkpyitqttphyhiekgkiglrfvpegqhlwpspevgatrtgrskyaqd krltaeaflsvhelmpmmfyyfllrekyseevsaekvqgrikrviedvyavydafargei dtldrldacladkgirrghlprqmiailsgehkdmeekvrkklqemiadthrldmldrq tdrkirigrknaglpksgviadwlvrdmmrfqpvakdtsgkpinnskansteyrmlqral alfggekerltpyfrqmnitggnnphpflhetrweshtnilsfyrsylkarkaflqsigr sdreenhrflllkepktdrqtivagwksefhlprgifteavrdcliemgydevgsykevg fmakavplyferackdrvqpfydypfnvgnslkpkkgrflskekraeewesgkerfrlak lkkeileakehpyldfkswqkferelrlvknqdiitwmmcrdlmeenkvegldtgtlylk |

TABLE 13-continued dirtevqeqgslnvinrvkpmrlpvvvyradsrghvhkeqaplatvyieerdtkllkqgn
fksfvkdrringlfsfvdtgglamegypisklrveyelakyqtarvcafeqtleleessll
trcphlpdknfrkmleswsdplldkwpdlqrevwlliavrnafshnqypmydeavfssir
kydpsspdaieermglniahrlseevkqakemaeriiqa (SEQ ID NO: 627)

TABLE 14

| | |
|---|---|
| *Bacteroidetes bacterium* GWA2_31_9 (hypothetical protein A2033_10205) >OFX18020 | mengtqkgkgiyyyytknedkhyfgsflnl annniegiieefrirlslkdeknikeiinn yftdkksytdwerginilkeylpvidyldl aitdkefekidlkgketakrkyfrtnfsll idtiidlrnfythyfhkpisinpdvakfld knlnveldikkgkmktdktkgalkdgldk elkklielkkaelkekkiktwnitenvega vyndafnhmvyknnagvtilkdyhksilpd dkidselklnfsisglvfllsmflskkeie gfksnlegfkgkvigengeyeiskfnnslk ymathwifsyltfkglkgrvkntfdketll mgmidelnkvphevygtlskeggnefledi neyvgdneenkksmensivvhpvirkrydd kfnyfairfldefanfptlkffvtagnfvh dkrekgiggsmltsdrmikekinvfgklte iakyksdyfsnentletsewelfpnpsyll ignnipvhidlihnteeakgegiaidrike ttnpakkrntrkskeeiikiiyqknkniky gdptallssnelpaliyellvnkksgkele niivekivngyktiagfekggnlsnslitk klkksepnedkinaekiilainreleiten klniiknnraefrtgakrkhifyskelgge atwiaydlkrfmpeasrkewkgfhhselgk flafydrnkndakallnmfwnfdndglign dlnsafrefhfdkfyekylikrdeilegfk sfisnfkdepkllkkgikdiyrvfdkryyi ikstnagkegllskpielprgifdnkptyi egvkvesnsalfadwygytysdkhefgsfy dmprdyegfekfelnniksignkknlnks dkfiyfrykqdlkikgiksgdlfiklmvde lfnvvfknnielnlkklygtsderfkngli advgknrekgdtsdnkmnenfiwnmtipls lengggieepkvklkdigkfrkletddkvig lleydkskvwkkleiedelenmpnsyerir rekllkgigefehfllekekfdginhpkhf egdlnpnfktyvingvlrknsklnyteidk lldlehisikdietsakeihlayflihvrn kfghnglpkleafelmkkyykknneetyae yfhkvssqivnefknslekhs (SEQ ID NO: 628) |
| *Chryseobacterium jejuense* (hypothetical protein SAMN05421542_0666) >SDI27289.1 | mektgtglgiyydhtklqdkyffggffnla gnnidnvikafiikffperkdkdiniagfl diefkdndadsdfqkknkflrihfpvigfl tsdndkagfkkkfalllktiselrnfythy yhksiefpselfelddifvkttseikklk kkddktggllnknlseeydiryggierlk elkaqgkrvsltdetairngvfnaafnhli yrdgenvkpsrlyqssysepdpaengisls qnsilfllsmflerketedlksrvkgfkak iikqgeegisglkfmathwvfsylcfkgik qklstefheetlliqiidelskvpdevysa fdsktkekfledineymkegnadlsledsk vihpvirkryenkfnyfairfldeylssts lkfqvhvgnyvhdrrvkhingtgfqteriv kdrikvfgrlsnisnlkadyikeqlelpnd sngweifpnpsyifidnnvpihvladeatk kgielfkdkrrkeqpeelqkrkgkiskyni vsmiykeakgkdklrideplallslneipa llyqilekgatpkdieliknkterfeki knydpetpapasqiskrlrnnttakgqeal naeklsllieresientetklssieekrlka kkeqrrntpqrsifsnsdlgriaawladdi krfmpaeqrknwkgyqhsqlqqslayfekr pqeaflllkegwdtsdgssywnnwvmnsfl ennhfekfyknylmkrvkyfselagnikqh thntkflrkfikqqmpadlfpkrhyilkdl eteknkvlskplvfsrglfdnnptfikgvk vtenpelfaewysygyktehvfqhfygwer dynelldselqkgnsfaknsiyynresqld liklkqdlkikkikiqdlflkriaeklfen vfnyptlsldefyltqeeraekerialaq slreegdnspniikddfiwsktiafrskqi yepaiklkdigkfnrfvlddeeskaskllls ydknkiwnkeqlerelsigensyevirrek lfkeignlelqilsnwswdginhprefeme dqkntrhpnfkmylvngilrkninlykede dfwleslkendfktlpsevletksemvqll flvilirnqfahnqlpeiqfynfirknype iqnntvaelylnliklavqklkdns (SEQ ID NO: 629) |
| *Chryseobacterium carnipullonun* (hypothetical protein SAMN05444360_11366) >SHM52812.1 | mntrvtgmgvsydhtkkedkhffggflnla qdnitavikafcikfdknpmssvqfaescf tdkdsdtdfqnkvryvrthlpvigylnygg drntfrqklstllkavdslrnfythyyhsp lalstelfelldtvfasvavevkqhkmkdd ktrqllskslaeeldirykqqlerlkelke qgknidlrdeagirngvinaafnhliykeg eiakptlsyssfyygadsaengitisqsgl lfllsmflgkkeiedlksrirgfkakivrd geenisglkfmathwifsylsfkgmkgrls tdfheetlliqiidelskvpdevyhdfdta trekfvedineyiregnedfslgdstiihp virkryenkfnyfavrfldefikfpslrfq vhlgnfvhdrrikdihgtgfqtervvkdri kvfgklseisslkteyiekeldldsdtgwe ifpnpsyvfidnnipiyistnktfkngsse fiklrrkekpeeemkmrgedkkekrdiasmi gnagslnsktplamlslnempallyeilvk kttpeeieliikekldshfeniknydpekp lpasqiskrlrnnttdkgkkvinpeklihl inkeidateakfallaknrkelkekfrgkp lrqtifsnmelgreatwladdikrfmpdil rknwkgyqhnqlqqslaffnsrpkeaftil qdgwdfadgssfwngwiinsfvknrsfeyf yeayfegrkeyfsslaenikqhtsnhrnlr rfidqqmpkglfenrhyllenleteknkil skplvfprglfdtkptfikgikvdeqpelf aewyqygystehvfqnfygwerdyndlles elekdndfsknsihysrtsqleliklkqdl kikkikiqdlflkliaghifenifkypasf sldelyltqeerinkeqealiqsqrkegdh sdniikdnfigsktvtyeskqisepnvklk digkfnrflldkvktllsynedkvwnknd ldlelsigensyevirreklfkkiqnfelq tltdwpwngtdhpeefgttdnkgvnhpnfk myvvngilrkhtdwfkegednwlenlneth fknlsfqeletksksiqtafliimirnqfa hnqlpavqffefiqkkypeiggsttselyl nfinlavvellellek (SEQ ID NO: 630) |
| *Chryseobacterium ureilyticum* (hypothetical protein SAMN05421786_1011119) >SIS70481.1 | metqilgngisydhtktedkhffggflnta qnnidllikayiskfessprklnsvqfpdv cfkkndsdadfqhklqfirkhlpviqylky ggnrevlkekfrlllqavdslrnfythfyh kpiqlpnelltlldtifgeignevrqnkmk ddktrhllkknlseeldfryqeqlerlrkl ksegkkvdlrdteairngvinaafnhlifk daedfkptvsyssyyydsdtaengisisqs gllfllsmflgrremedlksrvrgfkarii kheeqhvsglkfmathwvfsefcfkgiktr |

TABLE 14-continued

| | |
|---|---|
| | lnadyheetlliglidelskvpdelyrsfd vatrerfiedineyirdgkedkslieskiv hpvirkryeskfnyfairfldefvnfptlr fqvhagnyvhdrriksiegtgfkterlvkd rikvfgklstisslkaeylakavnitddtg wellphpsyvfidnnipihltvdpsfkngv keyqekrklqkpeemknrqggdkmhkpais skigkskdinpespvallsmneipallyei lvkkaspeeveakirqkltavferirdydp kvplpasqvskrlrnntdtlsynkeklvel ankeveqterklalitknrrecrekvkgkf krqkvfknaelgteatwlandikrfmpeeq kknwkgyqhsqlqqslaffesrpgearsll qagwdfsdgssfwngwvmnsfardntfdgf yesylngrmkyflrladniaqqsstnklis nfikqqmpkglfdrrlymledlateknkil skplifprgifddkptfkkgvvqseepeaf adwysygydvkhkfqefyawdrdyeellre elekdtaftknsihysresqiellakkqdl kvkkvriqdlylklmaeflfenvfghelal pldqfyltqeerlkqeqeaivqsqrpkgdd spnivkenfiwsktipfksgrvfepnvklk digkfrnlltdekvdillsynnteigkqvi eneliigagsyefirreqlfkeiqqmkrls lrsvrgmgvpirinlk (SEQ ID NO: 631) |
| *Sinomicrobium oceani* >WP_072319476.1 | mestttlglhlkyqhdlfedkhyfgggvnl avgniesifqafaerygiqnplrkngvpai nnifhdnisisnykeylkflkqylpvvgfl eksneinifefredfeilinaiyklrhfyt hyyhspikledrfytclnelfvavaiqvkk hkmksdktrqllnknlhqllqqlieqkrek lkdkkaegekvsldtksienavindafvhl ldkdenirinyssrlsediitkngitlsis gllfllslflqrkeaedlrsriegfkgkgn elrfmathwvfsylnvkrikhrintdfqke tlligiadelskvpdevyktldhenrskfl edineyiregnedaslnestvvhgvirkry enkfhylvlryldefvdfpslrfqvhlgny ihdrrdkvidgtnfitnrvikepikvfgkl shvsklksdymeslsrehkngwdvfpnpsy nfvghnipifinlrsasskgkelyrdlmki ksekkkksreegipmerrdgkptkieisnq idrnikdnnfkdiypgeplamlslnelpal lfellrrpsitpqdiedrmveklyerfqii rdykpgdglstskiskklrkadnstrldgk kllraiqtetrnareklhtleenkalqknr krrtvyttreqgreaswlaqdlkrfmpias rkewrgyhhsqlqqilafydqnpkqplell eqfwdlkedtyvwnswihkslsqhngfvpm yegylkgrlgyykklesdiigfleehkvlk ryytqqhlnvifrerlyfiktetkqklell arplvfprgifddkptfvqdkkvvdhpelf adwyvysykddhsfqefyhykrdyneifet elswdidfkdnkrqlnpseqmdlfrmkwdl kikkikiqdiflkivaediylkifghkipl slsdfyisrgerltldeqavaqsmrlpgdt ksenqikesnlwqttvpyekeqirepkikl digkfkyflqqqkvinllkydpqhvwtkae leeelyigkhsyevvrremllqkchqlekh |
| | ilegfrfdgsnhpreleggnhpnfkmyivn giltkrgeleieaenwwlelgnsknsldkv evelltmktipeqkaflililirnkfahnql padnyfhyasnlmnlkksdtyslfwftvad tivqefmsl (SEQ ID NO: 632) |
| *Reichenbachiella agariperforans* >WP073124441.1 | mktnpliassgekpnykkfntesdksfkki fqnkgsiapiaekacknfeikskspvnrdg rlhyfsvghafknidsknvfryeldesqmd mkptqflalqkeffdfqgalngllkhirnv nshyvhtfekleiqsinqklitflieafel avihsylneeelsyeaykddpqsgqklvqf lcdkfypnkeheveerktilaknkrgaleh sllfievtsdidwklfekhkvftisngkyl fhaclfllslflykseangliskikgfkrn ddnqyrskrqiftffskkftsqdvnseeqh lvkfrdviqylnhypsawnkhlelksgypq mtdklmryiveaelyrsfpdqtdnhrfllf aireffgqscldtwtgntpinfsnqeqkgf syeintsaeikdietklkalvlkgpinfke kkeqnrlekdlrrekkeqptnrvkeklltr ighnmlyvsygrnqdrfmdfaarflaetdy fgkdakfkmyqfytsdeqrdhlkeqkkelp kkefeklkyhqsklvdyftyaeqqarypdw dtpfvvennaiqikvtlfngakkivsvqrn lmlylledalysekrenagkglisgyfvhh qkelkdqldileketeisreqkrefkkllp krilhryspaqindttewnpmevileeaka qeqryqlllekailhqteedflkrnkgkqf klrfvrkawhlmylkelymnkvaehghhks fhitkeefndfcrwmfafdevpkykeylcd yfsqkgffnnaefkdliesstslndlyekt kqrfegwskdltkqsdenkyllanyesmlk ddmlyvnishfisyleskgkinrnahghia ykalnnvphlieeyyykdrlapeeykshgk lynklktvkledallyemamhylslepalv pkvktkvkdilssniafdikdaaghhlyhl lipfhkidsfvalinhqsqqekdpdktsfl akiqpylekvknskdlkavyhyykdtphtl ryedlnmihshivsgsvqftkvalkleeyf iakksitlqiargisyseiadlsnyftdev rntafhfdvpetaysmilqgiesefldrei kpqkpkslselstqqvsvctafletlhnnl fdrkddkkerlskareryfeqin (SEQ ID NO: 633) |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (636 sequences)

SEQ ID NO: 1 - protein, 15 aa, Artificial Sequence
  Synthetic Peptide
  misc_feature (4)..(4): Xaa can be any naturally occurring amino acid
DKHXFGAFLNLARHN

SEQ ID NO: 2 - protein, 12 aa, Artificial Sequence
  Synthetic Peptide
GLLFFVSLFLDK

SEQ ID NO: 3 - protein, 7 aa, Artificial Sequence
  Synthetic Peptide
  misc_feature (4)..(4): Xaa can be any naturally occurring amino acid
SKIXGFK

SEQ ID NO: 4 - protein, 10 aa, Artificial Sequence
  Synthetic Peptide
  misc_feature (7)..(7): Xaa can be any naturally occurring amino acid
DMLNELXRCP

SEQ ID NO: 5 - protein, 15 aa, Artificial Sequence
  Synthetic Peptide
  misc_feature (2)..(2): Xaa can be any naturally occurring amino acid
  misc_feature (14)..(14): Xaa can be any naturally occurring amino acid
RXZDRFPYFALRYXD

SEQ ID NO: 6 - protein, 10 aa, Artificial Sequence
  Synthetic Peptide
  misc_feature (9)..(9): Xaa can be any naturally occurring amino acid
LRFQVBLGXY

SEQ ID NO: 7 - protein, 10 aa, Artificial Sequence
  Synthetic Peptide
GLLFFVSLFL

SEQ ID NO: 8 - protein, 9 aa, Artificial Sequence
  Synthetic Peptide
  misc_feature (4)..(4): Xaa can be any naturally occurring amino acid
RHQXRFPYF

SEQ ID NO: 9 - protein, 8 aa, Artificial Sequence
  Synthetic Peptide
RHQDRFPY

SEQ ID NO: 10 - RNA, 45 nt, Cypridina noctiluca
auugaaugcagaguagaggccgcaggauaguuuagaacauucuau

SEQ ID NO: 11 - RNA, 66 nt, Cypridina noctiluca
ucuaaaccauccugcggccucuacucugcaguuguggaagguccaguuuugggggcuauuacaaca

SEQ ID NO: 12 - DNA, 105 bp, Cypridina noctiluca
tgccgaaugugucaguauguaauugaaugcagaguagaggccgcaggauaguuuagaacauucuauggaaagagauuccaguuccaggaaccugguacauacgug

SEQ ID NO: 13 - RNA, 24 nt, Artificial Sequence
  Synthetic Oligonucleotide
  misc_feature (1)..(4): n is a, c, g, or u
nnnngacuacagucccgaaacuag

SEQ ID NO: 14 - RNA, 65 nt, Artificial Sequence
  Synthetic Oligonucleotide
ucgucuaugugcugugcugggcacccuucuuccuggugcagcuguaggccgcgugggacccggag

SEQ ID NO: 15 - RNA, 50 nt, Artificial Sequence
  Synthetic Oligonucleotide
gucccacgcggcccacagcugcaccaggaagaagggugcccagcacagca

SEQ ID NO: 16 - RNA, 50 nt, Artificial Sequence
  Synthetic Oligonucleotide
gggucccacgcggcccacagcugcaccaggaagaagggugcccagcacag

SEQ ID NO: 17 - RNA, 50 nt, Artificial Sequence
  Synthetic Oligonucleotide
ccgggucccacgcggcccacagcugcaccaggaagaagggugcccagcac

SEQ ID NO: 18 - RNA, 65 nt, Artificial Sequence
  Synthetic Oligonucleotide
ccucaacuuccugcucugggcuccuggaggccacacgaucgccuaggaugucaucacccugaugg

SEQ ID NO: 19 - RNA, 50 nt, Artificial Sequence
  Synthetic Oligonucleotide
ggugaugacaucccaggcgaucguguggccuccaggagcccagagcagga

SEQ ID NO: 20 - RNA, 50 nt, Artificial Sequence
  Synthetic Oligonucleotide
agggugaugacaucccaggcgaucguguggccuccaggagcccagagcag

SEQ ID NO: 21 - RNA, 50 nt, Artificial Sequence
  Synthetic Oligonucleotide
aucagggugaugacaucccaggcgaucguguggccuccaggagcccagag

SEQ ID NO: 22 - RNA, 99 nt, Artificial Sequence
  Synthetic Oligonucleotide
cccaggugcgggagagaggccugcugaaaaugacugaauauaaacuugugguaguuggagcugguggcguaggcaagagugccuugacgauacagcuaa

SEQ ID NO: 23 - RNA, 50 nt, Artificial Sequence
  Synthetic Oligonucleotide
caccacaaguuuauauucagucauuuucagcaggccucucucccgcaccu

SEQ ID NO: 24 - RNA, 50 nt, Artificial Sequence
  Synthetic Oligonucleotide
gcuccaaccaccacaaguuuauauucagucauuuucagcaggccucucuc

SEQ ID NO: 25 - RNA, 50 nt, Artificial Sequence
  Synthetic Oligonucleotide
cgccaccagcuccaaccaccacaaguuuauauucagucauuuucagcagg

SEQ ID NO: 26 - RNA, 50 nt, Artificial Sequence
  Synthetic Oligonucleotide
cuugccuacgccaccagcuccaaccaccacaaguuuauauucagucauuu

SEQ ID NO: 27 - RNA, 50 nt, Artificial Sequence
  Synthetic Oligonucleotide
aaggcacucuugccuacgccaccagcuccaaccaccacaaguuuauauuc

SEQ ID NO: 28 - DNA, 50 bp, Artificial Sequence
  Synthetic Oligonucleotide
guatcgucaaggcacucuugccuacgccaccagcuccaaccaccacaagu

SEQ ID NO: 29 - RNA, 50 nt, Artificial Sequence
  Synthetic Oligonucleotide
aauuagcuguaucgucaaggcacucuugccuacgccaccagcuccaacca

SEQ ID NO: 30 - RNA, 20 nt, Artificial Sequence
  Synthetic Oligonucleotide
uuccccacauuagacguuca

SEQ ID NO: 31 - RNA, 20 nt, Artificial Sequence
  Synthetic Oligonucleotide
ugaacggccaauguggggaa

SEQ ID NO: 32 - DNA, 44 bp, Cypridina noctiluca
tatgtaattgaatgcagagtagaggccgcaggatagtttagaac

SEQ ID NO: 33 - DNA, 36 bp, Cypridina noctiluca
tatgtaattgaatgcagccgcaggatggtttggagc

SEQ ID NO: 34 - DNA, 37 bp, Cypridina noctiluca
tatgtaattgaatgcagaccgcaggatagtttagaac

SEQ ID NO: 35 - DNA, 38 bp, Cypridina noctiluca
tatgtaattgaatgcagagccgcaggatggtttggaac

SEQ ID NO: 36 - DNA, 38 bp, Cypridina noctiluca
tatgtaattgaatgcagagtggaaggatagtttagaac

SEQ ID NO: 37 - DNA, 38 bp, Cypridina noctiluca
tatgtaattgaatgcagagtagaaggatggtttagaac

SEQ ID NO: 38 - DNA, 38 bp, Cypridina noctiluca
tgtgtaattgaatgcagagtggaaggatggtttagaac

SEQ ID NO: 39 - DNA, 38 bp, Cypridina noctiluca
tatgtaattgaatgcagagtggaagggtggtttggaac

SEQ ID NO: 40 - DNA, 38 bp, Cypridina noctiluca; identical to SEQ ID NO: 37

SEQ ID NO: 41 - DNA, 39 bp, Cypridina noctiluca
tatgtaattgaatgcagagtagagaggatggtttggaac

SEQ ID NO: 42 - DNA, 39 bp, Cypridina noctiluca
tgtgtaattgaatgcagagtggagaggatggtttagaac

SEQ ID NO: 43 - DNA, 39 bp, Cypridina noctiluca
tatgtaattgaatgcagagtggagaggatggtttagagc

SEQ ID NO: 44 - DNA, 39 bp, Cypridina noctiluca
tatgtaattgaatgcagagtagagaggatggtttagaac

SEQ ID NO: 45 - DNA, 39 bp, Cypridina noctiluca
tatgtaattgaatgcagagtggaggccgcggtttggaac

SEQ ID NO: 46 - DNA, 39 bp, Cypridina noctiluca
tatgtaattgaatgcagagtagagaccgcggtttggagc

SEQ ID NO: 47 - DNA, 39 bp, Cypridina noctiluca
tatgtaattgaatgcagagtggaggccgcagtttggagc

SEQ ID NO: 48 - DNA, 39 bp, Cypridina noctiluca
tatgtaattgaatgcagagtagaggccgcaggttggaac

SEQ ID NO: 49 - DNA, 39 bp, Cypridina noctiluca
tgtgtaattgaatgcagagtggaggccgcaggttagaac

SEQ ID NO: 50 - DNA, 39 bp, Cypridina noctiluca
tatgtaattgaatgcagagtggaggccgcaggttggaac

SEQ ID NO: 51 - DNA, 39 bp, Cypridina noctiluca; identical to SEQ ID NO: 50

SEQ ID NO: 52 - DNA, 38 bp, Cypridina noctiluca
tatgtaattgaatgcagagtagaggccgcaggtggagc

SEQ ID NO: 53 - DNA, 44 bp, Cypridina noctiluca; identical to SEQ ID NO: 32

SEQ ID NO: 54 - DNA, 39 bp, Cypridina noctiluca
tatgtaattgaatgcagagtccgcaggatggtttagaac

SEQ ID NO: 55 - DNA, 38 bp, Cypridina noctiluca
tatgtaattgaatgcagagtagcaggatagtttagaac

SEQ ID NO: 56 - DNA, 38 bp, Cypridina noctiluca
tatgtaattgaatgcagagtagaaggatagtttagaac

SEQ ID NO: 57 - DNA, 39 bp, Cypridina noctiluca
tatgtaattgaatgcagagtagagaggatagtttagaac

SEQ ID NO: 58 - DNA, 39 bp, Cypridina noctiluca; identical to SEQ ID NO: 44

SEQ ID NO: 59 - DNA, 39 bp, Cypridina noctiluca; identical to SEQ ID NO: 44

SEQ ID NO: 60 - DNA, 39 bp, Cypridina noctiluca; identical to SEQ ID NO: 57

SEQ ID NO: 61 - DNA, 38 bp, Cypridina noctiluca
tatgtaattgaatgcagagtagaggcatggtttagaac

SEQ ID NO: 62 - DNA, 39 bp, Cypridina noctiluca
tatgtaattgaatgcagagtagaggccatagtttagaac

SEQ ID NO: 63 - DNA, 39 bp, Cypridina noctiluca
tatgtaattgaatgcagagtagaggccatggtttagaac

SEQ ID NO: 64 - DNA, 38 bp, Cypridina noctiluca
tatgtaattgaatgcagagtagaggcctagtttagaac

SEQ ID NO: 65 - DNA, 38 bp, Cypridina noctiluca
tatgtaattgaatgcagagtagaggcctggtttagaac

SEQ ID NO: 66 - DNA, 39 bp, Cypridina noctiluca
tatgtaattgaatgcagagtagaggccgcagtttagaac

SEQ ID NO: 67 - DNA, 39 bp, Cypridina noctiluca
tatgtaattgaatgcagagtagaggccgcaggttagaac

SEQ ID NO: 68 - DNA, 39 bp, Cypridina noctiluca; identical to SEQ ID NO: 67

SEQ ID NO: 69 - DNA, 36 bp, Cypridina noctiluca
taattgaatgcagagtagaggccgcaggaggtttag

SEQ ID NO: 70 - DNA, 37 bp, Cypridina noctiluca
attgaatgcagagtagaggccgcaggatggtttagaa

SEQ ID NO: 71 - DNA, 37 bp, Cypridina noctiluca
attgaatgcagagtagaggccgcaggatggtttagga

SEQ ID NO: 72 - DNA, 37 bp, Cypridina noctiluca; identical to SEQ ID NO: 70

SEQ ID NO: 73 - DNA, 37 bp, Cypridina noctiluca; identical to SEQ ID NO: 70

SEQ ID NO: 74 - RNA, 39 nt, Artificial Sequence
  Synthetic Oligonucleotide
  misc_feature (4)..(5): n is a, c, g, or u
  misc_feature (36)..(39): n is a, c, g, or u
augnnuugccaccgacgacaccgugaggauaaauunnnn

SEQ ID NO: 75 - RNA, 36 nt, Artificial Sequence
  Synthetic Oligonucleotide
uggaggugcucaaagagauggaagccaaugcccgga

SEQ ID NO: 76 - RNA, 36 nt, Artificial Sequence
  Synthetic Oligonucleotide
  misc_feature (1)..(1): n is a, c, g, or u
nggaggugcucaaagagauggaagccaaugcccgga

SEQ ID NO: 77 - RNA, 36 nt, Artificial Sequence
  Synthetic Oligonucleotide
  misc_feature (2)..(2): n is a, c, g, or u
ungaggugcucaaagagauggaagccaaugcccgga

SEQ ID NO: 78 - RNA, 36 nt, Artificial Sequence
  Synthetic Oligonucleotide
  misc_feature (3)..(3): n is a, c, g, or u
ugnaggugcucaaagagauggaagccaaugcccgga

SEQ ID NO: 79 - RNA, 36 nt, Artificial Sequence
  Synthetic Oligonucleotide
  misc_feature (4)..(4): n is a, c, g, or u
uggnggugcucaaagagauggaagccaaugcccgga

SEQ ID NO: 80 - RNA, 36 nt, Artificial Sequence
  Synthetic Oligonucleotide
  misc_feature (18)..(18): n is a, c, g, or u
uggaggugcucaaagagnuggaagccaaugcccgga

SEQ ID NO: 81 - RNA, 36 nt, Artificial Sequence
  Synthetic Oligonucleotide
  misc_feature (36)..(36): n is a, c, g, or u
uggaggugcucaaagagauggaagccaaugcccggn

SEQ ID NO: 82 - RNA, 36 nt, Artificial Sequence
  Synthetic Oligonucleotide
  misc_feature (1)..(2): n is a, c, g, or u
nngaggugcucaaagagauggaagccaaugcccgga

SEQ ID NO: 83 - RNA, 36 nt, Artificial Sequence
  Synthetic Oligonucleotide
  misc_feature (1)..(1): n is a, c, g, or u
  misc_feature (3)..(3): n is a, c, g, or u
ngnaggugcucaaagagauggaagccaaugcccgga

SEQ ID NO: 84 - RNA, 36 nt, Artificial Sequence
  Synthetic Oligonucleotide
  misc_feature (1)..(1): n is a, c, g, or u
  misc_feature (4)..(4): n is a, c, g, or u
nggnggugcucaaagagauggaagccaaugcccgga

SEQ ID NO: 85 - RNA, 36 nt, Artificial Sequence
  Synthetic Oligonucleotide
  misc_feature (1)..(1): n is a, c, g, or u
  misc_feature (5)..(5): n is a, c, g, or u
nggangugcucaaagagauggaagccaaugcccgga

SEQ ID NO: 86 - RNA, 36 nt, Artificial Sequence
  Synthetic Oligonucleotide
  misc_feature (14)..(14): n is a, c, g, or u
  misc_feature (18)..(18): n is a, c, g, or u
uggaggugcucaangagnuggaagccaaugcccgga

SEQ ID NO: 87 - RNA, 36 nt, Artificial Sequence
  Synthetic Oligonucleotide
  misc_feature (35)..(36): n is a, c, g, or u
uggaggugcucaaagagauggaagccaaugcccgnn

SEQ ID NO: 88 - RNA, 36 nt, Artificial Sequence; identical to SEQ ID NO: 75
  Synthetic Oligonucleotide

SEQ ID NO: 89 - RNA, 34 nt, Artificial Sequence
  Synthetic Oligonucleotide
agagauggaagccaaugcccggaaagcuggcugc

SEQ ID NO: 90 - RNA, 36 nt, Artificial Sequence; identical to SEQ ID NO: 75
  Synthetic Oligonucleotide

SEQ ID NO: 91 - RNA, 34 nt, Artificial Sequence; identical to SEQ ID NO: 89
  Synthetic Oligonucleotide

SEQ ID NO: 92 - RNA, 34 nt, Artificial Sequence; identical to SEQ ID NO: 89
  Synthetic Oligonucleotide

SEQ ID NO: 93 - RNA, 34 nt, Artificial Sequence; identical to SEQ ID NO: 89
  Synthetic Oligonucleotide

SEQ ID NO: 94 - RNA, 56 nt, Artificial Sequence
  Synthetic Oligonucleotide
aguauguaauugaaugcagaguagaggccgcaggauaguuuagaacauucuaugga

SEQ ID NO: 95 - RNA, 50 nt, Artificial Sequence
  Synthetic Oligonucleotide
  misc_feature (17)..(17): n is a, c, g, or u
auagaauguucuaaacnauccugcggccucuacucugcauucaauuacau

SEQ ID NO: 96 - RNA, 59 nt, Artificial Sequence
  Synthetic Oligonucleotide
auguaauugaaugcagaguagaggccgcaggauaguuuagaacauucuauggaaagaga

SEQ ID NO: 97 - RNA, 83 nt, Artificial Sequence
  Synthetic Oligonucleotide
ucuuuccauaggcccugaaaaagggccuguucuaaaccauccugcggccucuacucggcccugaaaaagggccauucaauuac

SEQ ID NO: 98 - RNA, 21 nt, Artificial Sequence
  Synthetic Oligonucleotide
ggccgcaggauaguuuagaac

SEQ ID NO: 99 - RNA, 82 nt, Artificial Sequence
  Synthetic Oligonucleotide
accgguggaauaguauaacaauaugcaaaauguuguuauaguaucccaccucuaaaccauccugcggggcccuagggcccuu

SEQ ID NO: 100 - protein, 7 aa, Simian virus 40
PKKKRKV

SEQ ID NO: 101 - protein, 16 aa, Simian virus 40
KRPAATKKAGQAKKKK

SEQ ID NO: 102 - protein, 9 aa, Homo sapiens
PAAKRVKLD

SEQ ID NO: 103 - protein, 11 aa, Homo sapiens
RQRRNELKRSP

SEQ ID NO: 104 - protein, 38 aa, Homo sapiens
NQSSNFGPMKGGNFGGRSSGPYGGGGQYFAKPRNQGGY

SEQ ID NO: 105 - protein, 42 aa, Homo sapiens
RMRIZFKNKGKDTAELRRRRVEVSVELRKAKKDEQILKRRNV

SEQ ID NO: 106 - protein, 8 aa, Homo sapiens
VSRKRPRP

SEQ ID NO: 107 - protein, 8 aa, Homo sapiens
PPKKARED

SEQ ID NO: 108 - protein, 8 aa, Homo sapiens
PQPKKKPL

SEQ ID NO: 109 - protein, 12 aa, Mus sp.
SALIKKKKKMAP

SEQ ID NO: 110 - protein, 5 aa, Influenza virus
DRLRR

SEQ ID NO: 111 - protein, 7 aa, Influenza virus
PKQKKRK

SEQ ID NO: 112 - protein, 10 aa, Hepatitis D virus
RKLKKKIKKL

SEQ ID NO: 113 - protein, 10 aa, Mus sp.
REKKKFLKRR

SEQ ID NO: 114 - protein, 20 aa, Homo sapiens
KRKGDEVDGVDEVAKKKSKK

SEQ ID NO: 115 - protein, 17 aa, Homo sapiens
RKCLQAGMNLEARKTKK

SEQ ID NO: 116 - protein, 11 aa, Artificial Sequence
  Synthetic Peptide
LYPERLRRILT

SEQ ID NO: 117 - protein, 33 aa, Artificial Sequence
  Synthetic Peptide
CTGTACCCTGAGCGGCTGCGGCGGATCCTGACC

SEQ ID NO: 118 - protein, 15 aa, Artificial Sequence
  Synthetic Peptide
  misc_feature (4)..(4): Xaa can be any naturally occurring amino acid
DKHXFGAFLNLARHN

SEQ ID NO: 119 - protein, 12 aa, Artificial Sequence
  Synthetic Peptide
GLLFFVSLFLDK

SEQ ID NO: 120 - protein, 7 aa, Artificial Sequence
  Synthetic Peptide
  misc_feature (4)..(4): Xaa can be any naturally occurring amino acid
SKIXGFK

SEQ ID NO: 121 - protein, 10 aa, Artificial Sequence
  Synthetic Peptide
  misc_feature (7)..(7): Xaa can be any naturally occurring amino acid
DMLNELXRCP

SEQ ID NO: 122 - protein, 15 aa, Artificial Sequence
  Synthetic Peptide
  misc_feature (2)..(2): Xaa can be any naturally occurring amino acid
  misc_feature (14)..(14): Xaa can be any naturally occurring amino acid
RXZDRFPYFALRYXD

SEQ ID NO: 123 - protein, 10 aa, Artificial Sequence
  Synthetic Oligonucleotide
  misc_feature (9)..(9): Xaa can be any naturally occurring amino acid
LRFQVBLGXY

SEQ ID NO: 124 - protein, 10 aa, Artificial Sequence
  Synthetic Peptide
GLLFFVSLFL

SEQ ID NO: 125 - protein, 9 aa, Artificial Sequence
  Synthetic Peptide
  misc_feature (4)..(4): Xaa can be any naturally occurring amino acid
RHQXRFPYF

SEQ ID NO: 126 - protein, 8 aa, Artificial Sequence
  Synthetic Peptide
RHQDRFPY

SEQ ID NO: 127 - protein, 4 aa, Artificial Sequence
  Synthetic Peptide
GGGS

SEQ ID NO: 128 - protein, 15 aa, Artificial Sequence
  Synthetic Peptide
GGGGSGGGGSGGGGS

SEQ ID NO: 129 - protein, 30 aa, Artificial Sequence
  Synthetic Peptide
GGGGSGGGGSGGGGSGGGGSGGGGSGGGGS

SEQ ID NO: 130 - protein, 45 aa, Artificial Sequence
  Synthetic Peptide
GGGGSGGGGSGGGGSGGGGSGGGGSGGGGSGGGGSGGGGSGGGGS

SEQ ID NO: 131 - protein, 60 aa, Artificial Sequence
  Synthetic Peptide
GGGGSGGGGSGGGGSGGGGSGGGGSGGGGSGGGGSGGGGSGGGGSGGGGSGGGGSGGGGS

SEQ ID NO: 132 - protein, 12 aa, Artificial Sequence
  Synthetic Peptide
FWYHKMILVAGC

SEQ ID NO: 133 - protein, 12 aa, Artificial Sequence
  Synthetic Peptide
WYHKREDCSTNQ

SEQ ID NO: 134 - protein, 9 aa, Artificial Sequence
  Synthetic Peptide
VCAGSPTND

SEQ ID NO: 135 - RNA, 25 nt, Artificial Sequence
  Synthetic Oligonucleotide
gggaacaaagcugaaguacuuaccc

SEQ ID NO: 136 - RNA, 12 nt, Artificial Sequence
  Synthetic Oligonucleotide
  misc_feature (1)..(1): 5 prime Biotin modification
  misc_feature (12)..(12): 3 prime Iowa Black modification
ucucguacguuc

SEQ ID NO: 137 - RNA, 24 nt, Artificial Sequence
  Synthetic Oligonucleotide
  misc_feature (1)..(1): 5 prime Biotin modification
  misc_feature (24)..(24): 3 prime Iowa Black modification
ucucguacguucucucguacguuc

SEQ ID NO: 138 - protein, 20 aa, Artificial Sequence
  Synthetic Peptide
GGGGSGGGGSGGGGSGGGGS

SEQ ID NO: 139 - protein, 25 aa, Artificial Sequence
  Synthetic Peptide
GGGGSGGGGSGGGGSGGGGSGGGGS

SEQ ID NO: 140 - protein, 35 aa, Artificial Sequence
  Synthetic Peptide
GGGGSGGGGSGGGGSGGGGSGGGGSGGGGSGGGGS

SEQ ID NO: 141 - protein, 40 aa, Artificial Sequence
  Synthetic Peptide
GGGGSGGGGSGGGGSGGGGSGGGGSGGGGSGGGGSGGGGS

SEQ ID NO: 142 - protein, 50 aa, Artificial Sequence
  Synthetic Peptide
GGGGSGGGGSGGGGSGGGGSGGGGSGGGGSGGGGSGGGGSGGGGSGGGGS

SEQ ID NO: 143 - protein, 55 aa, Artificial Sequence
  Synthetic Peptide
GGGGSGGGGSGGGGSGGGGSGGGGSGGGGSGGGGSGGGGSGGGGSGGGGSGGGGS

SEQ ID NO: 144 - protein, 15 aa, Artificial Sequence
  Synthetic Peptide
GSGGSGGSGGSGGSG

SEQ ID NO: 145 - protein, 32 aa, Artificial Sequence
  Synthetic Peptide
LEPGEKPYKCPECGKSFSQSGALTRHQRTHTR

SEQ ID NO: 146 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 147 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 148 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 149 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 150 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 151 - protein, 953 aa, Alistipes species
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 152 - protein, 1322 aa, Prevotella species
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 153 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 154 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 155 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 156 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 157 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 158 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 159 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 160 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 161 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 162 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 163 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 164 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 165 - protein, 1175 aa, Porphyromonas species
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 166 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 167 - DNA, 30 bp, Artificial Sequence
  Synthetic Oligonucleotide
gggcattggcttccatctctttgagcacct

SEQ ID NO: 168 - DNA, 30 bp, Artificial Sequence
  Synthetic Oligonucleotide
gcagggttttcccagtcacgacgttgtaaa

SEQ ID NO: 169 - DNA, 30 bp, Artificial Sequence
  Synthetic Oligonucleotide
gaagtcttcgttgttctcggtgggcttggc

SEQ ID NO: 170 - DNA, 30 bp, Artificial Sequence; identical to SEQ ID NO: 167
  Synthetic Oligonucleotide

SEQ ID NO: 171 - DNA, 30 bp, Artificial Sequence
  Synthetic Oligonucleotide
gacaggcagatcagacagcccctggtgcag

SEQ ID NO: 172 - DNA, 30 bp, Artificial Sequence
  Synthetic Oligonucleotide
gtaggtgtggcagcgtcctgggatgaactt

SEQ ID NO: 173 - DNA, 30 bp, Artificial Sequence
  Synthetic Oligonucleotide
ggaatgtcgacgatcgcctcgcctatgccg

SEQ ID NO: 174 - DNA, 28 bp, Artificial Sequence
  Synthetic Oligonucleotide
agtcttcgttgttctcggtgggcttggc

SEQ ID NO: 175 - DNA, 28 bp, Artificial Sequence
  Synthetic Oligonucleotide
gcattggcttccatctctttgagcacct

SEQ ID NO: 176 - DNA, 28 bp, Artificial Sequence
  Synthetic Oligonucleotide
caggcagatcagacagcccctggtgcag

SEQ ID NO: 177 - DNA, 28 bp, Artificial Sequence
  Synthetic Oligonucleotide
aggtgtggcagcgtcctgggatgaactt

SEQ ID NO: 178 - DNA, 28 bp, Artificial Sequence
  Synthetic Oligonucleotide
aatgtcgacgatcgcctcgcctatgccg

SEQ ID NO: 179 - DNA, 30 bp, Artificial Sequence; identical to SEQ ID NO: 168
  Synthetic Oligonucleotide

SEQ ID NO: 180 - DNA, 28 bp, Artificial Sequence
  Synthetic Oligonucleotide
agggttttcccagtcacgacgttgtaaa

SEQ ID NO: 181 - DNA, 30 bp, Artificial Sequence; identical to SEQ ID NO: 167
  Synthetic Oligonucleotide

SEQ ID NO: 182 - DNA, 30 bp, Artificial Sequence; identical to SEQ ID NO: 168
  Synthetic Oligonucleotide

SEQ ID NO: 183 - protein, 7 aa, Artificial Sequence
  Synthetic Peptide
GSGGGGS

SEQ ID NO: 184 - protein, 15 aa, Artificial Sequence
  Synthetic Peptide
GGGGSGGGGSGGGGS

SEQ ID NO: 185 - protein, 5 aa, Artificial Sequence
  Synthetic Peptide
EAAAK

SEQ ID NO: 186 - protein, 18 aa, Artificial Sequence
  Synthetic Peptide
GGSGGSGGSGGSGGSGGS

SEQ ID NO: 187 - protein, 16 aa, Artificial Sequence
  Synthetic Peptide
SGSETPGTSESATPES

SEQ ID NO: 188 - protein, 7 aa, Artificial Sequence
  Synthetic Peptide
GSGGGGS

SEQ ID NO: 189 - protein, 7 aa, Artificial Sequence
  Synthetic Peptide
GSGGGGS

SEQ ID NO: 190 - protein, 7 aa, Artificial Sequence
  Synthetic Peptide
GSGGGGS

SEQ ID NO: 191 - protein, 15 aa, Artificial Sequence
  Synthetic Peptide
GGGGSGGGGSGGGGS

SEQ ID NO: 192 - protein, 5 aa, Artificial Sequence
  Synthetic Peptide
EAAAK

SEQ ID NO: 193 - protein, 18 aa, Artificial Sequence
  Synthetic Peptide
GGSGGSGGSGGSGGSGGS

SEQ ID NO: 194 - protein, 16 aa, Artificial Sequence
  Synthetic Peptide
SGSETPGTSESATPES

SEQ ID NO: 195 - RNA, 28 nt, Artificial Sequence
  Synthetic Oligonucleotide
gccagcuuuccgggcauuggcuuccauc

SEQ ID NO: 196 - DNA, 28 bp, Artificial Sequence
  Synthetic Oligonucleotide
gccagctttccgggcattggcttccatc

SEQ ID NO: 197 - DNA, 28 bp, Artificial Sequence
  Synthetic Oligonucleotide
acccaggaatctcaggaatgtcgacgat

SEQ ID NO: 198 - DNA, 28 bp, Artificial Sequence
  Synthetic Oligonucleotide
agggttttcccagtcacgacgttgtaaa

SEQ ID NO: 199 - DNA, 30 bp, Artificial Sequence; identical to SEQ ID NO: 167
  Synthetic Oligonucleotide

SEQ ID NO: 200 - RNA, 30 nt, Artificial Sequence
  Synthetic Oligonucleotide
gugcagccagcuuuccgggcauuggcuucc

SEQ ID NO: 201 - RNA, 30 nt, Artificial Sequence
  Synthetic Oligonucleotide
gcagccagcuuuccgggcauuggcuuccau

SEQ ID NO: 202 - RNA, 30 nt, Artificial Sequence
  Synthetic Oligonucleotide
ggcuuccaucucuuugagcaccuccagcgg

SEQ ID NO: 203 - RNA, 30 nt, Artificial Sequence
  Synthetic Oligonucleotide
ggaaugucgacgaucgccucgccuaugccg

SEQ ID NO: 204 - RNA, 30 nt, Artificial Sequence
  Synthetic Oligonucleotide
gaaugucgacgaucgccucgccuaugccgc

SEQ ID NO: 205 - RNA, 30 nt, Artificial Sequence
  Synthetic Oligonucleotide
gaccugugcgaugaacugcuccaugggcuc

SEQ ID NO: 206 - RNA, 30 nt, Artificial Sequence
  Synthetic Oligonucleotide
guguggcagcguccugggaugaacuucuuc

SEQ ID NO: 207 - RNA, 30 nt, Artificial Sequence
  Synthetic Oligonucleotide
guggcagcguccugggaugaacuucuucau

SEQ ID NO: 208 - RNA, 30 nt, Artificial Sequence
  Synthetic Oligonucleotide
gcuucuugccgggcaacuucccgcggucag

SEQ ID NO: 209 - RNA, 31 nt, Artificial Sequence
  Synthetic Oligonucleotide
gcaggguuuucccagucacgacguuguaaaa

SEQ ID NO: 210 - RNA, 31 nt, Artificial Sequence; identical to SEQ ID NO: 209
  Synthetic Oligonucleotide

SEQ ID NO: 211 - RNA, 28 nt, Artificial Sequence
  Synthetic Oligonucleotide
acccaggaaucucaggaaugucgacgau

SEQ ID NO: 212 - DNA, 21 bp, Artificial Sequence
  Synthetic Oligonucleotide
cagctttccgggcattggctt

SEQ ID NO: 213 - RNA, 30 nt, Artificial Sequence
  Synthetic Oligonucleotide
ccgcuggaggugcucaaagagauggaagcc

SEQ ID NO: 214 - DNA, 28 bp, Artificial Sequence
  Synthetic Oligonucleotide
gccagctttccgggcattggcttccatc

SEQ ID NO: 215 - DNA, 28 bp, Artificial Sequence
  Synthetic Oligonucleotide
acccaggaatctcaggaatgtcgacgat

SEQ ID NO: 216 - DNA, 30 bp, Artificial Sequence; identical to SEQ ID NO: 167
  Synthetic Oligonucleotide

SEQ ID NO: 217 - RNA, 30 nt, Artificial Sequence; identical to SEQ ID NO: 204
  Synthetic Oligonucleotide

SEQ ID NO: 218 - DNA, 28 bp, Artificial Sequence
  Synthetic Oligonucleotide
caaggcactcttgcctacgccaccagct

SEQ ID NO: 219 - DNA, 28 bp, Artificial Sequence
  Synthetic Oligonucleotide
tcatattcgtccacaaaatgattctgaa

SEQ ID NO: 220 - DNA, 28 bp, Artificial Sequence
  Synthetic Oligonucleotide
attatttatggcaaatacacaaagaaag

SEQ ID NO: 221 - DNA, 28 bp, Artificial Sequence
  Synthetic Oligonucleotide
gaatatcttcaaatgatttagtattatt

SEQ ID NO: 222 - DNA, 28 bp, Artificial Sequence
  Synthetic Oligonucleotide
accataggtacatcttcagagtccttaa

SEQ ID NO: 223 - DNA, 30 bp, Artificial Sequence
  Synthetic Oligonucleotide
gtcaaggcactcttgcctacgccaccagct

SEQ ID NO: 224 - DNA, 30 bp, Artificial Sequence
  Synthetic Oligonucleotide
gatcatattcgtccacaaaatgattctgaa

SEQ ID NO: 225 - DNA, 30 bp, Artificial Sequence
  Synthetic Oligonucleotide
gtattatttatggcaaatacacaaagaaag

SEQ ID NO: 226 - DNA, 30 bp, Artificial Sequence
  Synthetic Oligonucleotide
gtgaatatcttcaaatgatttagtattatt

SEQ ID NO: 227 - DNA, 30 bp, Artificial Sequence
  Synthetic Oligonucleotide
ggaccataggtacatcttcagagtccttaa

SEQ ID NO: 228 - DNA, 50 bp, Artificial Sequence
  Synthetic Oligonucleotide
aagagtgccttgacgatacagcctcgaggctgtatcgtcaaggcactctt

SEQ ID NO: 229 - DNA, 48 bp, Artificial Sequence
  Synthetic Oligonucleotide
aatcattttgtggacgaatatctcgagatattcgtccacaaaatgatt

SEQ ID NO: 230 - DNA, 48 bp, Artificial Sequence
  Synthetic Oligonucleotide
aaataatactaaatcatttgactcgagtcaaatgatttagtattattt

SEQ ID NO: 231 - DNA, 48 bp, Artificial Sequence
  Synthetic Oligonucleotide
aataatactaaatcatttgaactcgagttcaaatgatttagtattatt

SEQ ID NO: 232 - DNA, 48 bp, Artificial Sequence
  Synthetic Oligonucleotide
aaggactctgaagatgtacctctcgagaggtacatcttcagagtcctt

SEQ ID NO: 233 - DNA, 30 bp, Artificial Sequence
  Synthetic Oligonucleotide
gagatcagggcaaacagaactttgactccc

SEQ ID NO: 234 - DNA, 30 bp, Artificial Sequence
  Synthetic Oligonucleotide
ggatgcagatcagggcaaacagaactttga

SEQ ID NO: 235 - DNA, 30 bp, Artificial Sequence
  Synthetic Oligonucleotide
gcacagcgatgcagatcagggcaaacagaa

SEQ ID NO: 236 - DNA, 30 bp, Artificial Sequence
  Synthetic Oligonucleotide
gctcggccacagcgatgcagatcagggcaa

SEQ ID NO: 237 - DNA, 30 bp, Artificial Sequence
  Synthetic Oligonucleotide
ggggcttggcctcggccacagcgatgcaga

SEQ ID NO: 238 - DNA, 30 bp, Artificial Sequence
  Synthetic Oligonucleotide
gtgggcttggcctcggccacagcgatgcag

SEQ ID NO: 239 - DNA, 30 bp, Artificial Sequence
  Synthetic Oligonucleotide
gtctcggtgggcttggcctcggccacagcg

SEQ ID NO: 240 - DNA, 30 bp, Artificial Sequence
  Synthetic Oligonucleotide
gttcgttgttctcggtgggcttggcctcgg

SEQ ID NO: 241 - DNA, 30 bp, Artificial Sequence
  Synthetic Oligonucleotide
ggaagtcttcgttgttctcggtgggcttgg

SEQ ID NO: 242 - DNA, 30 bp, Artificial Sequence
  Synthetic Oligonucleotide
gatgttgaagtcttcgttgttctcggtggg

SEQ ID NO: 243 - DNA, 30 bp, Artificial Sequence
  Synthetic Oligonucleotide
gcggccacgatgttgaagtcttcgttgttc

SEQ ID NO: 244 - DNA, 30 bp, Artificial Sequence
  Synthetic Oligonucleotide
gtggccacggccacgatgttgaagtcttcg

SEQ ID NO: 245 - DNA, 30 bp, Artificial Sequence
  Synthetic Oligonucleotide
ggttgctggccacggccacgatgttgaagt

SEQ ID NO: 246 - DNA, 30 bp, Artificial Sequence
  Synthetic Oligonucleotide
gtcgcgaagttgctggccacggccacgatg

SEQ ID NO: 247 - DNA, 30 bp, Artificial Sequence
  Synthetic Oligonucleotide
gccgtggtcgcgaagttgctggccacggcc

SEQ ID NO: 248 - DNA, 30 bp, Artificial Sequence
  Synthetic Oligonucleotide
gcgagatccgtggtcgcgaagttgctggcc

SEQ ID NO: 249 - DNA, 30 bp, Artificial Sequence
  Synthetic Oligonucleotide
gcagcatcgagatccgtggtcgcgaagttg

SEQ ID NO: 250 - DNA, 30 bp, Artificial Sequence
  Synthetic Oligonucleotide
gggtcagcatcgagatccgtggtcgcgaag

SEQ ID NO: 251 - DNA, 30 bp, Artificial Sequence
  Synthetic Oligonucleotide
gcttcccgcggtcagcatcgagatccgtgg

SEQ ID NO: 252 - DNA, 30 bp, Artificial Sequence
  Synthetic Oligonucleotide
ggggcaacttcccgcggtcagcatcgagat

SEQ ID NO: 253 - DNA, 30 bp, Artificial Sequence
  Synthetic Oligonucleotide
gtcttgccgggcaacttcccgcggtcagca

SEQ ID NO: 254 - DNA, 30 bp, Artificial Sequence
  Synthetic Oligonucleotide
ggcagcttcttgccgggcaacttcccgcgg

SEQ ID NO: 255 - DNA, 30 bp, Artificial Sequence
  Synthetic Oligonucleotide
gccagcggcagcttcttgccgggcaacttc

SEQ ID NO: 256 - DNA, 30 bp, Artificial Sequence
  Synthetic Oligonucleotide
gcacctccagcggcagcttcttgccgggca

SEQ ID NO: 257 - DNA, 30 bp, Artificial Sequence
  Synthetic Oligonucleotide
gctttgagcacctccagcggcagcttcttg

SEQ ID NO: 258 - DNA, 30 bp, Artificial Sequence
  Synthetic Oligonucleotide
gcatctctttgagcacctccagcggcagct

SEQ ID NO: 259 - DNA, 30 bp, Artificial Sequence
  Synthetic Oligonucleotide
gtccatctctttgagcacctccagcggcag

SEQ ID NO: 260 - DNA, 30 bp, Artificial Sequence; identical to SEQ ID NO: 167
  Synthetic Oligonucleotide

SEQ ID NO: 261 - DNA, 30 bp, Artificial Sequence
  Synthetic Oligonucleotide
gtccgggcattggcttccatctctttgagc

SEQ ID NO: 262 - DNA, 30 bp, Artificial Sequence
  Synthetic Oligonucleotide
ggccagctttccgggcattggcttccatct

SEQ ID NO: 263 - DNA, 30 bp, Artificial Sequence
  Synthetic Oligonucleotide
gggtgcagccagctttccgggcattggctt

SEQ ID NO: 264 - DNA, 30 bp, Artificial Sequence
  Synthetic Oligonucleotide
gagcccctggtgcagccagctttccgggca

SEQ ID NO: 265 - DNA, 30 bp, Artificial Sequence
  Synthetic Oligonucleotide
gatcagacagcccctggtgcagccagcttt

SEQ ID NO: 266 - DNA, 30 bp, Artificial Sequence
  Synthetic Oligonucleotide
ggcagatcagacagcccctggtgcagccag

SEQ ID NO: 267 - DNA, 30 bp, Artificial Sequence; identical to SEQ ID NO: 171
  Synthetic Oligonucleotide

SEQ ID NO: 268 - DNA, 30 bp, Artificial Sequence
  Synthetic Oligonucleotide
gtgatgtgggacaggcagatcagacagccc

SEQ ID NO: 269 - DNA, 30 bp, Artificial Sequence
  Synthetic Oligonucleotide
gacttgatgtgggacaggcagatcagacag

SEQ ID NO: 270 - DNA, 30 bp, Artificial Sequence
  Synthetic Oligonucleotide
ggggcgtgcacttgatgtgggacaggcaga

SEQ ID NO: 271 - DNA, 30 bp, Artificial Sequence
  Synthetic Oligonucleotide
gcttcatcttgggcgtgcacttgatgtggg

SEQ ID NO: 272 - DNA, 30 bp, Artificial Sequence
  Synthetic Oligonucleotide
gtgaacttcttcatcttgggcgtgcacttg

SEQ ID NO: 273 - DNA, 30 bp, Artificial Sequence
  Synthetic Oligonucleotide
gggatgaacttcttcatcttgggcgtgcac

SEQ ID NO: 274 - DNA, 30 bp, Artificial Sequence
  Synthetic Oligonucleotide
gtgggatgaacttcttcatcttgggcgtgc

SEQ ID NO: 275 - DNA, 30 bp, Artificial Sequence
  Synthetic Oligonucleotide
gggcagcgtcctgggatgaacttcttcatc

SEQ ID NO: 276 - DNA, 30 bp, Artificial Sequence
  Synthetic Oligonucleotide
gggtgtggcagcgtcctgggatgaacttct

SEQ ID NO: 277 - DNA, 30 bp, Artificial Sequence
  Synthetic Oligonucleotide
gttcgtaggtgtggcagcgtcctgggatga

SEQ ID NO: 278 - DNA, 30 bp, Artificial Sequence
  Synthetic Oligonucleotide
gcgccttcgtaggtgtggcagcgtcctggg

SEQ ID NO: 279 - DNA, 30 bp, Artificial Sequence
  Synthetic Oligonucleotide
gtctttgtcgccttcgtaggtgtggcagcg

SEQ ID NO: 280 - DNA, 30 bp, Artificial Sequence
  Synthetic Oligonucleotide
gctttgtcgccttcgtaggtgtggcagcgt

SEQ ID NO: 281 - DNA, 30 bp, Artificial Sequence
  Synthetic Oligonucleotide
gtgccgccctgtgcggactctttgtcgcct

SEQ ID NO: 282 - DNA, 30 bp, Artificial Sequence
  Synthetic Oligonucleotide
gtatgccgccctgtgcggactctttgtcgc

SEQ ID NO: 283 - DNA, 30 bp, Artificial Sequence
  Synthetic Oligonucleotide
gcctcgcctatgccgccctgtgcggactct

SEQ ID NO: 284 - DNA, 30 bp, Artificial Sequence
  Synthetic Oligonucleotide
ggatcgcctcgcctatgccgccctgtgcgg

SEQ ID NO: 285 - DNA, 30 bp, Artificial Sequence
  Synthetic Oligonucleotide
gatgtcgacgatcgcctcgcctatgccgcc

SEQ ID NO: 286 - DNA, 30 bp, Artificial Sequence
  Synthetic Oligonucleotide
gcaggaatgtcgacgatcgcctcgcctatg

SEQ ID NO: 287 - DNA, 30 bp, Artificial Sequence
  Synthetic Oligonucleotide
gaatctcaggaatgtcgacgatcgcctcgc

SEQ ID NO: 288 - DNA, 30 bp, Artificial Sequence
  Synthetic Oligonucleotide
gcccaggaatctcaggaatgtcgacgatcg

SEQ ID NO: 289 - DNA, 30 bp, Artificial Sequence
  Synthetic Oligonucleotide
gccttgaacccaggaatctcaggaatgtcg

SEQ ID NO: 290 - DNA, 30 bp, Artificial Sequence
  Synthetic Oligonucleotide
gccaagtccttgaacccaggaatctcagga

SEQ ID NO: 291 - DNA, 30 bp, Artificial Sequence
  Synthetic Oligonucleotide
gtgggctccaagtccttgaacccaggaatc

SEQ ID NO: 292 - DNA, 30 bp, Artificial Sequence
  Synthetic Oligonucleotide
gccatgggctccaagtccttgaacccagga

SEQ ID NO: 293 - DNA, 30 bp, Artificial Sequence
  Synthetic Oligonucleotide
ggaactgctccatgggctccaagtccttga

SEQ ID NO: 294 - DNA, 30 bp, Artificial Sequence
  Synthetic Oligonucleotide
gtgcgatgaactgctccatgggctccaagt

SEQ ID NO: 295 - DNA, 30 bp, Artificial Sequence
  Synthetic Oligonucleotide
ggacctgtgcgatgaactgctccatgggct

SEQ ID NO: 296 - DNA, 30 bp, Artificial Sequence
  Synthetic Oligonucleotide
gacagatcgacctgtgcgatgaactgctcc

SEQ ID NO: 297 - DNA, 30 bp, Artificial Sequence
  Synthetic Oligonucleotide
gacacacagatcgacctgtgcgatgaactg

SEQ ID NO: 298 - DNA, 30 bp, Artificial Sequence
  Synthetic Oligonucleotide
gtgcagtccacacacagatcgacctgtgcg

SEQ ID NO: 299 - DNA, 30 bp, Artificial Sequence
  Synthetic Oligonucleotide
gccagttgtgcagtccacacacagatcgac

SEQ ID NO: 300 - DNA, 30 bp, Artificial Sequence
  Synthetic Oligonucleotide
gggcagccagttgtgcagtccacacacaga

SEQ ID NO: 301 - DNA, 30 bp, Artificial Sequence
  Synthetic Oligonucleotide
gtttgaggcagccagttgtgcagtccacac

SEQ ID NO: 302 - DNA, 30 bp, Artificial Sequence
  Synthetic Oligonucleotide
gaagccctttgaggcagccagttgtgcagt

SEQ ID NO: 303 - DNA, 30 bp, Artificial Sequence
  Synthetic Oligonucleotide
gcacgttggcaagccctttgaggcagccag

SEQ ID NO: 304 - DNA, 30 bp, Artificial Sequence
  Synthetic Oligonucleotide
gactgcacgttggcaagccctttgaggcag

SEQ ID NO: 305 - DNA, 30 bp, Artificial Sequence
  Synthetic Oligonucleotide
gggtcagaacactgcacgttggcaagccct

SEQ ID NO: 306 - DNA, 30 bp, Artificial Sequence
  Synthetic Oligonucleotide
gcaggtcagaacactgcacgttggcaagcc

SEQ ID NO: 307 - DNA, 30 bp, Artificial Sequence
  Synthetic Oligonucleotide
gagcaggtcagaacactgcacgttggcaag

SEQ ID NO: 308 - DNA, 30 bp, Artificial Sequence
  Synthetic Oligonucleotide
ggccacttcttgagcaggtcagaacactgc

SEQ ID NO: 309 - DNA, 30 bp, Artificial Sequence
  Synthetic Oligonucleotide
gcggcagccacttcttgagcaggtcagaac

SEQ ID NO: 310 - DNA, 30 bp, Artificial Sequence
  Synthetic Oligonucleotide
gtgcggcagccacttcttgagcaggtcaga

SEQ ID NO: 311 - DNA, 30 bp, Artificial Sequence
  Synthetic Oligonucleotide
gagcgttgcggcagccacttcttgagcagg

SEQ ID NO: 312 - DNA, 30 bp, Artificial Sequence
  Synthetic Oligonucleotide
gaaaggtcgcacagcgttgcggcagccact

SEQ ID NO: 313 - DNA, 30 bp, Artificial Sequence
  Synthetic Oligonucleotide
gctggcaaaggtcgcacagcgttgcggcag

SEQ ID NO: 314 - DNA, 30 bp, Artificial Sequence
  Synthetic Oligonucleotide
gggcaaaggtcgcacagcgttgcggcagcc

SEQ ID NO: 315 - DNA, 30 bp, Artificial Sequence
  Synthetic Oligonucleotide
gtggatcttgctggcaaaggtcgcacagcg

SEQ ID NO: 316 - DNA, 30 bp, Artificial Sequence
  Synthetic Oligonucleotide
gcacctggccctggatcttgctggcaaagg

SEQ ID NO: 317 - DNA, 30 bp, Artificial Sequence
  Synthetic Oligonucleotide
gtggccctggatcttgctggcaaaggtcgc

SEQ ID NO: 318 - DNA, 30 bp, Artificial Sequence
  Synthetic Oligonucleotide
gtgatcttgtccacctggccctggatcttg

SEQ ID NO: 319 - DNA, 30 bp, Artificial Sequence
  Synthetic Oligonucleotide
gccccttgatcttgtccacctggccctgga

SEQ ID NO: 320 - DNA, 30 bp, Artificial Sequence
  Synthetic Oligonucleotide
gcccttgatcttgtccacctggccctggat

SEQ ID NO: 321 - DNA, 30 bp, Artificial Sequence
  Synthetic Oligonucleotide
gccttgatcttgtccacctggccctggatc

SEQ ID NO: 322 - DNA, 30 bp, Artificial Sequence
  Synthetic Oligonucleotide
ggcaaaggtcgcacagcgttgcggcagcca

SEQ ID NO: 323 - DNA, 30 bp, Artificial Sequence
  Synthetic Oligonucleotide
gcaaaggtcgcacagcgttgcggcagccac

SEQ ID NO: 324 - DNA, 30 bp, Artificial Sequence
  Synthetic Oligonucleotide
gaaggtcgcacagcgttgcggcagccactt

SEQ ID NO: 325 - DNA, 30 bp, Artificial Sequence
  Synthetic Oligonucleotide
gaggtcgcacagcgttgcggcagccacttc

SEQ ID NO: 326 - DNA, 31 bp, Artificial Sequence
  Synthetic Oligonucleotide
ggtaatgcctggcttgtcgacgcatagtctg

SEQ ID NO: 327 - DNA, 31 bp, Artificial Sequence
  Synthetic Oligonucleotide
gggaaccttggccgttataaagtctgaccag

SEQ ID NO: 328 - DNA, 31 bp, Artificial Sequence
  Synthetic Oligonucleotide
ggagggtgagaatttagaaccaagattgttg

SEQ ID NO: 329 - DNA, 30 bp, Artificial Sequence
  Synthetic Oligonucleotide
gagtcctggcaatgaacagtggcgcagtag

SEQ ID NO: 330 - DNA, 30 bp, Artificial Sequence
  Synthetic Oligonucleotide
gggtgccacagctgctatcaatacattctc

SEQ ID NO: 331 - DNA, 30 bp, Artificial Sequence
  Synthetic Oligonucleotide
gttacatactgacacattcggcaacatgtt

SEQ ID NO: 332 - DNA, 30 bp, Artificial Sequence
  Synthetic Oligonucleotide
gtatgtaccaggttcctggaactggaatct

SEQ ID NO: 333 - DNA, 30 bp, Artificial Sequence
  Synthetic Oligonucleotide
gccttggttccatccaggttctccagggtg

SEQ ID NO: 334 - DNA, 30 bp, Artificial Sequence
  Synthetic Oligonucleotide
gcagtgatgggattctcagtagcttgagcg

SEQ ID NO: 335 - DNA, 30 bp, Artificial Sequence
  Synthetic Oligonucleotide
gagcctggcatctcaacaacagcgatggtg

SEQ ID NO: 336 - DNA, 30 bp, Artificial Sequence
  Synthetic Oligonucleotide
gtgtctggggcgattcttacagatcttcct

SEQ ID NO: 337 - DNA, 30 bp, Artificial Sequence
  Synthetic Oligonucleotide
gctggatctgaagtgaagtctgtatcttcc

SEQ ID NO: 338 - DNA, 30 bp, Artificial Sequence
  Synthetic Oligonucleotide
ggcaacgtcatcaggatttccatagagtgg

SEQ ID NO: 339 - DNA, 30 bp, Artificial Sequence
  Synthetic Oligonucleotide
gaggcgcaggagatggtgtagtagtagaag

SEQ ID NO: 340 - DNA, 30 bp, Artificial Sequence
  Synthetic Oligonucleotide
gagggaccctggaattggtatcttgctttg

SEQ ID NO: 341 - DNA, 30 bp, Artificial Sequence
  Synthetic Oligonucleotide
ggtaagagtcaacattcctgtgtgaaacct

SEQ ID NO: 342 - DNA, 30 bp, Artificial Sequence
  Synthetic Oligonucleotide
gaccagaatctgttttccatcaacaatgag

SEQ ID NO: 343 - DNA, 30 bp, Artificial Sequence
  Synthetic Oligonucleotide
gatggctgtagtcagtatgtcaccatcttg

SEQ ID NO: 344 - DNA, 30 bp, Artificial Sequence
  Synthetic Oligonucleotide
gtaccatcgaatggatctctaatatgtacg

SEQ ID NO: 345 - DNA, 30 bp, Artificial Sequence
  Synthetic Oligonucleotide
gagatcacaggctccttcagcatcaaaaga

SEQ ID NO: 346 - DNA, 30 bp, Artificial Sequence
  Synthetic Oligonucleotide
gctttgaccggcgaagagactattgcagag

SEQ ID NO: 347 - DNA, 30 bp, Artificial Sequence
  Synthetic Oligonucleotide
gcccctcaggcaatactcgtacatgcatcg

SEQ ID NO: 348 - DNA, 30 bp, Artificial Sequence
  Synthetic Oligonucleotide
gctggtacttctagggtgtctccatgcttt

SEQ ID NO: 349 - DNA, 31 bp, Artificial Sequence; identical to SEQ ID NO: 326
  Synthetic Oligonucleotide

SEQ ID NO: 350 - DNA, 31 bp, Artificial Sequence; identical to SEQ ID NO: 327
  Synthetic Oligonucleotide

SEQ ID NO: 351 - DNA, 31 bp, Artificial Sequence; identical to SEQ ID NO: 328
  Synthetic Oligonucleotide

SEQ ID NO: 352 - DNA, 31 bp, Artificial Sequence
  Synthetic Oligonucleotide
gcatcctgcggcctctactctgcattcaatt

SEQ ID NO: 353 - DNA, 31 bp, Artificial Sequence
  Synthetic Oligonucleotide
gaccatcctgcggcctctactctgcattcaa

SEQ ID NO: 354 - DNA, 31 bp, Artificial Sequence
  Synthetic Oligonucleotide
gaaaccatcctgcggcctctactctgcattc

SEQ ID NO: 355 - DNA, 31 bp, Artificial Sequence
  Synthetic Oligonucleotide
gctaaaccatcctgcggcctctactctgcat

SEQ ID NO: 356 - DNA, 31 bp, Artificial Sequence
  Synthetic Oligonucleotide
gttctaaaccatcctgcggcctctactctgc

SEQ ID NO: 357 - DNA, 31 bp, Artificial Sequence
  Synthetic Oligonucleotide
gtgttctaaaccatcctgcggcctctactct

SEQ ID NO: 358 - DNA, 31 bp, Artificial Sequence
  Synthetic Oligonucleotide
gaatgttctaaaccatcctgcggcctctact

SEQ ID NO: 359 - DNA, 31 bp, Artificial Sequence
  Synthetic Oligonucleotide
gagaatgttctaaaccatcctgcggcctcta

SEQ ID NO: 360 - DNA, 31 bp, Artificial Sequence
  Synthetic Oligonucleotide
gatagaatgttctaaaccatcctgcggcctc

SEQ ID NO: 361 - DNA, 31 bp, Artificial Sequence
  Synthetic Oligonucleotide
gccatagaatgttctaaaccatcctgcggcc

SEQ ID NO: 362 - DNA, 31 bp, Artificial Sequence
  Synthetic Oligonucleotide
gttccatagaatgttctaaaccatcctgcgg

SEQ ID NO: 363 - DNA, 31 bp, Artificial Sequence
  Synthetic Oligonucleotide
gctttccatagaatgttctaaaccatcctgc

SEQ ID NO: 364 - DNA, 31 bp, Artificial Sequence
  Synthetic Oligonucleotide
gctctttccatagaatgttctaaaccatcct

SEQ ID NO: 365 - DNA, 31 bp, Artificial Sequence
  Synthetic Oligonucleotide
gatctctttccatagaatgttctaaaccatc

SEQ ID NO: 366 - DNA, 31 bp, Artificial Sequence
  Synthetic Oligonucleotide
ggaatctctttccatagaatgttctaaacca

SEQ ID NO: 367 - DNA, 51 bp, Artificial Sequence
  Synthetic Oligonucleotide
gcatcctgcggcctctactctgcattcaattacatactgacacattcggca

SEQ ID NO: 368 - DNA, 51 bp, Artificial Sequence
  Synthetic Oligonucleotide
gaccatcctgcggcctctactctgcattcaattacatactgacacattcgg

SEQ ID NO: 369 - DNA, 51 bp, Artificial Sequence
  Synthetic Oligonucleotide
gaaaccatcctgcggcctctactctgcattcaattacatactgacacattc

SEQ ID NO: 370 - DNA, 51 bp, Artificial Sequence
  Synthetic Oligonucleotide
gctaaaccatcctgcggcctctactctgcattcaattacatactgacacat

SEQ ID NO: 371 - DNA, 51 bp, Artificial Sequence
  Synthetic Oligonucleotide
gttctaaaccatcctgcggcctctactctgcattcaattacatactgacac

SEQ ID NO: 372 - DNA, 51 bp, Artificial Sequence
  Synthetic Oligonucleotide
gtgttctaaaccatcctgcggcctctactctgcattcaattacatactgac

SEQ ID NO: 373 - DNA, 51 bp, Artificial Sequence
  Synthetic Oligonucleotide
gaatgttctaaaccatcctgcggcctctactctgcattcaattacatactg

SEQ ID NO: 374 - DNA, 51 bp, Artificial Sequence
  Synthetic Oligonucleotide
gagaatgttctaaaccatcctgcggcctctactctgcattcaattacatac

SEQ ID NO: 375 - DNA, 51 bp, Artificial Sequence
  Synthetic Oligonucleotide
gatagaatgttctaaaccatcctgcggcctctactctgcattcaattacat

SEQ ID NO: 376 - DNA, 51 bp, Artificial Sequence
  Synthetic Oligonucleotide
gccatagaatgttctaaaccatcctgcggcctctactctgcattcaattac

SEQ ID NO: 377 - DNA, 51 bp, Artificial Sequence
  Synthetic Oligonucleotide
gttccatagaatgttctaaaccatcctgcggcctctactctgcattcaatt

SEQ ID NO: 378 - DNA, 51 bp, Artificial Sequence
  Synthetic Oligonucleotide
gctttccatagaatgttctaaaccatcctgcggcctctactctgcattcaa

SEQ ID NO: 379 - DNA, 51 bp, Artificial Sequence
  Synthetic Oligonucleotide
gctctttccatagaatgttctaaaccatcctgcggcctctactctgcattc

SEQ ID NO: 380 - DNA, 51 bp, Artificial Sequence
  Synthetic Oligonucleotide
gatctctttccatagaatgttctaaaccatcctgcggcctctactctgcat

SEQ ID NO: 381 - DNA, 51 bp, Artificial Sequence
  Synthetic Oligonucleotide
ggaatctctttccatagaatgttctaaaccatcctgcggcctctactctgc

SEQ ID NO: 382 - DNA, 51 bp, Artificial Sequence
  Synthetic Oligonucleotide
gtggaatctctttccatagaatgttctaaaccatcctgcggcctctactct

SEQ ID NO: 383 - DNA, 51 bp, Artificial Sequence
  Synthetic Oligonucleotide
gactggaatctctttccatagaatgttctaaaccatcctgcggcctctact

SEQ ID NO: 384 - DNA, 51 bp, Artificial Sequence
  Synthetic Oligonucleotide
ggaactggaatctctttccatagaatgttctaaaccatcctgcggcctcta

SEQ ID NO: 385 - DNA, 51 bp, Artificial Sequence
  Synthetic Oligonucleotide
gtggaactggaatctctttccatagaatgttctaaaccatcctgcggcctc

SEQ ID NO: 386 - DNA, 51 bp, Artificial Sequence
  Synthetic Oligonucleotide
gcctggaactggaatctctttccatagaatgttctaaaccatcctgcggcc

SEQ ID NO: 387 - DNA, 51 bp, Artificial Sequence
  Synthetic Oligonucleotide
gttcctggaactggaatctctttccatagaatgttctaaaccatcctgcgg

SEQ ID NO: 388 - DNA, 51 bp, Artificial Sequence
  Synthetic Oligonucleotide
gggttcctggaactggaatctctttccatagaatgttctaaaccatcctgc

SEQ ID NO: 389 - DNA, 51 bp, Artificial Sequence
  Synthetic Oligonucleotide
gcaggttcctggaactggaatctctttccatagaatgttctaaaccatcct

SEQ ID NO: 390 - DNA, 51 bp, Artificial Sequence
  Synthetic Oligonucleotide
gaccaggttcctggaactggaatctctttccatagaatgttctaaaccatc

SEQ ID NO: 391 - DNA, 51 bp, Artificial Sequence
  Synthetic Oligonucleotide
ggtaccaggttcctggaactggaatctctttccatagaatgttctaaacca

SEQ ID NO: 392 - DNA, 71 bp, Artificial Sequence
  Synthetic Oligonucleotide
gcatcctgcggcctctactctgcattcaattacatactgacacattcggcaacatgtttttcctggtttat

SEQ ID NO: 393 - DNA, 71 bp, Artificial Sequence
  Synthetic Oligonucleotide
gaccatcctgcggcctctactctgcattcaattacatactgacacattcggcaacatgtttttcctggttt

SEQ ID NO: 394 - DNA, 71 bp, Artificial Sequence
  Synthetic Oligonucleotide
gaaaccatcctgcggcctctactctgcattcaattacatactgacacattcggcaacatgtttttcctggt

SEQ ID NO: 395 - DNA, 71 bp, Artificial Sequence
  Synthetic Oligonucleotide
gctaaaccatcctgcggcctctactctgcattcaattacatactgacacattcggcaacatgtttttcctg

SEQ ID NO: 396 - DNA, 71 bp, Artificial Sequence
  Synthetic Oligonucleotide
gttctaaaccatcctgcggcctctactctgcattcaattacatactgacacattcggcaacatgtttttcc

SEQ ID NO: 397 - DNA, 71 bp, Artificial Sequence
  Synthetic Oligonucleotide
gtgttctaaaccatcctgcggcctctactctgcattcaattacatactgacacattcggcaacatgttttt

SEQ ID NO: 398 - DNA, 71 bp, Artificial Sequence
  Synthetic Oligonucleotide
gaatgttctaaaccatcctgcggcctctactctgcattcaattacatactgacacattcggcaacatgttt

SEQ ID NO: 399 - DNA, 71 bp, Artificial Sequence
  Synthetic Oligonucleotide
gagaatgttctaaaccatcctgcggcctctactctgcattcaattacatactgacacattcggcaacatgt

SEQ ID NO: 400 - DNA, 71 bp, Artificial Sequence
  Synthetic Oligonucleotide
gatagaatgttctaaaccatcctgcggcctctactctgcattcaattacatactgacacattcggcaacat

SEQ ID NO: 401 - DNA, 71 bp, Artificial Sequence
  Synthetic Oligonucleotide
gccatagaatgttctaaaccatcctgcggcctctactctgcattcaattacatactgacacattcggcaac

SEQ ID NO: 402 - DNA, 71 bp, Artificial Sequence
  Synthetic Oligonucleotide
gttccatagaatgttctaaaccatcctgcggcctctactctgcattcaattacatactgacacattcggca

SEQ ID NO: 403 - DNA, 71 bp, Artificial Sequence
  Synthetic Oligonucleotide
gctttccatagaatgttctaaaccatcctgcggcctctactctgcattcaattacatactgacacattcgg

SEQ ID NO: 404 - DNA, 71 bp, Artificial Sequence
  Synthetic Oligonucleotide
gctctttccatagaatgttctaaaccatcctgcggcctctactctgcattcaattacatactgacacattc

SEQ ID NO: 405 - DNA, 71 bp, Artificial Sequence
  Synthetic Oligonucleotide
gatctctttccatagaatgttctaaaccatcctgcggcctctactctgcattcaattacatactgacacat

SEQ ID NO: 406 - DNA, 71 bp, Artificial Sequence
  Synthetic Oligonucleotide
ggaatctctttccatagaatgttctaaaccatcctgcggcctctactctgcattcaattacatactgacac

SEQ ID NO: 407 - DNA, 71 bp, Artificial Sequence
  Synthetic Oligonucleotide
gtggaatctctttccatagaatgttctaaaccatcctgcggcctctactctgcattcaattacatactgac

SEQ ID NO: 408 - DNA, 71 bp, Artificial Sequence
  Synthetic Oligonucleotide
gactggaatctctttccatagaatgttctaaaccatcctgcggcctctactctgcattcaattacatactg

SEQ ID NO: 409 - DNA, 71 bp, Artificial Sequence
  Synthetic Oligonucleotide
ggaactggaatctctttccatagaatgttctaaaccatcctgcggcctctactctgcattcaattacatac

SEQ ID NO: 410 - DNA, 71 bp, Artificial Sequence
  Synthetic Oligonucleotide
gtggaactggaatctctttccatagaatgttctaaaccatcctgcggcctctactctgcattcaattacat

SEQ ID NO: 411 - DNA, 71 bp, Artificial Sequence
  Synthetic Oligonucleotide
gcctggaactggaatctctttccatagaatgttctaaaccatcctgcggcctctactctgcattcaattac

SEQ ID NO: 412 - DNA, 71 bp, Artificial Sequence
  Synthetic Oligonucleotide
gttcctggaactggaatctctttccatagaatgttctaaaccatcctgcggcctctactctgcattcaatt

SEQ ID NO: 413 - DNA, 71 bp, Artificial Sequence
  Synthetic Oligonucleotide
gggttcctggaactggaatctctttccatagaatgttctaaaccatcctgcggcctctactctgcattcaa

SEQ ID NO: 414 - DNA, 71 bp, Artificial Sequence
  Synthetic Oligonucleotide
gcaggttcctggaactggaatctctttccatagaatgttctaaaccatcctgcggcctctactctgcattc

SEQ ID NO: 415 - DNA, 71 bp, Artificial Sequence
  Synthetic Oligonucleotide
gaccaggttcctggaactggaatctctttccatagaatgttctaaaccatcctgcggcctctactctgcat

SEQ ID NO: 416 - DNA, 71 bp, Artificial Sequence
  Synthetic Oligonucleotide
ggtaccaggttcctggaactggaatctctttccatagaatgttctaaaccatcctgcggcctctactctgc

SEQ ID NO: 417 - DNA, 71 bp, Artificial Sequence
  Synthetic Oligonucleotide
gatgtaccaggttcctggaactggaatctctttccatagaatgttctaaaccatcctgcggcctctactct

SEQ ID NO: 418 - DNA, 71 bp, Artificial Sequence
  Synthetic Oligonucleotide
ggtatgtaccaggttcctggaactggaatctctttccatagaatgttctaaaccatcctgcggcctctact

SEQ ID NO: 419 - DNA, 71 bp, Artificial Sequence
  Synthetic Oligonucleotide
gacgtatgtaccaggttcctggaactggaatctctttccatagaatgttctaaaccatcctgcggcctcta

SEQ ID NO: 420 - DNA, 71 bp, Artificial Sequence
  Synthetic Oligonucleotide
gacacgtatgtaccaggttcctggaactggaatctctttccatagaatgttctaaaccatcctgcggcctc

SEQ ID NO: 421 - DNA, 71 bp, Artificial Sequence
  Synthetic Oligonucleotide
gcaacacgtatgtaccaggttcctggaactggaatctctttccatagaatgttctaaaccatcctgcggcc

SEQ ID NO: 422 - DNA, 71 bp, Artificial Sequence
  Synthetic Oligonucleotide
gcccaacacgtatgtaccaggttcctggaactggaatctctttccatagaatgttctaaaccatcctgcgg

SEQ ID NO: 423 - DNA, 71 bp, Artificial Sequence
  Synthetic Oligonucleotide
ggacccaacacgtatgtaccaggttcctggaactggaatctctttccatagaatgttctaaaccatcctgc

SEQ ID NO: 424 - DNA, 71 bp, Artificial Sequence
  Synthetic Oligonucleotide
gttgacccaacacgtatgtaccaggttcctggaactggaatctctttccatagaatgttctaaaccatcct

SEQ ID NO: 425 - DNA, 71 bp, Artificial Sequence
  Synthetic Oligonucleotide
gccttgacccaacacgtatgtaccaggttcctggaactggaatctctttccatagaatgttctaaaccatc

SEQ ID NO: 426 - DNA, 71 bp, Artificial Sequence
  Synthetic Oligonucleotide
gttccttgacccaacacgtatgtaccaggttcctggaactggaatctctttccatagaatgttctaaacca

SEQ ID NO: 427 - DNA, 85 bp, Artificial Sequence
  Synthetic Oligonucleotide
gcatcctgcggcctctactctgcattcaattacatactgacacattcggcaacatgtttttcctggtttattttcacacagtcca

SEQ ID NO: 428 - DNA, 85 bp, Artificial Sequence
  Synthetic Oligonucleotide
gaccatcctgcggcctctactctgcattcaattacatactgacacattcggcaacatgtttttcctggtttattttcacacagtc

SEQ ID NO: 429 - DNA, 85 bp, Artificial Sequence
  Synthetic Oligonucleotide
gaaaccatcctgcggcctctactctgcattcaattacatactgacacattcggcaacatgtttttcctggtttattttcacacag

SEQ ID NO: 430 - DNA, 85 bp, Artificial Sequence
  Synthetic Oligonucleotide
gctaaaccatcctgcggcctctactctgcattcaattacatactgacacattcggcaacatgtttttcctggtttattttcacac

SEQ ID NO: 431 - DNA, 85 bp, Artificial Sequence
  Synthetic Oligonucleotide
gttctaaaccatcctgcggcctctactctgcattcaattacatactgacacattcggcaacatgtttttcctggtttattttcac

SEQ ID NO: 432 - DNA, 85 bp, Artificial Sequence
  Synthetic Oligonucleotide
gtgttctaaaccatcctgcggcctctactctgcattcaattacatactgacacattcggcaacatgtttttcctggtttattttc

SEQ ID NO: 433 - DNA, 85 bp, Artificial Sequence
  Synthetic Oligonucleotide
gaatgttctaaaccatcctgcggcctctactctgcattcaattacatactgacacattcggcaacatgtttttcctggtttattt

SEQ ID NO: 434 - DNA, 85 bp, Artificial Sequence
  Synthetic Oligonucleotide
gagaatgttctaaaccatcctgcggcctctactctgcattcaattacatactgacacattcggcaacatgtttttcctggtttat

SEQ ID NO: 435 - DNA, 85 bp, Artificial Sequence
  Synthetic Oligonucleotide
gatagaatgttctaaaccatcctgcggcctctactctgcattcaattacatactgacacattcggcaacatgtttttcctggttt

SEQ ID NO: 436 - DNA, 85 bp, Artificial Sequence
  Synthetic Oligonucleotide
gccatagaatgttctaaaccatcctgcggcctctactctgcattcaattacatactgacacattcggcaacatgtttttcctggt

SEQ ID NO: 437 - DNA, 85 bp, Artificial Sequence
  Synthetic Oligonucleotide
gttccatagaatgttctaaaccatcctgcggcctctactctgcattcaattacatactgacacattcggcaacatgtttttcctg

SEQ ID NO: 438 - DNA, 85 bp, Artificial Sequence
  Synthetic Oligonucleotide
gctttccatagaatgttctaaaccatcctgcggcctctactctgcattcaattacatactgacacattcggcaacatgtttttcc

SEQ ID NO: 439 - DNA, 85 bp, Artificial Sequence
  Synthetic Oligonucleotide
gctctttccatagaatgttctaaaccatcctgcggcctctactctgcattcaattacatactgacacattcggcaacatgttttt

SEQ ID NO: 440 - DNA, 85 bp, Artificial Sequence
  Synthetic Oligonucleotide
gatctctttccatagaatgttctaaaccatcctgcggcctctactctgcattcaattacatactgacacattcggcaacatgttt

SEQ ID NO: 441 - DNA, 85 bp, Artificial Sequence
  Synthetic Oligonucleotide
ggaatctctttccatagaatgttctaaaccatcctgcggcctctactctgcattcaattacatactgacacattcggcaacatgt

SEQ ID NO: 442 - DNA, 85 bp, Artificial Sequence
  Synthetic Oligonucleotide
gtggaatctctttccatagaatgttctaaaccatcctgcggcctctactctgcattcaattacatactgacacattcggcaacat

SEQ ID NO: 443 - DNA, 85 bp, Artificial Sequence
  Synthetic Oligonucleotide
gactggaatctctttccatagaatgttctaaaccatcctgcggcctctactctgcattcaattacatactgacacattcggcaac

SEQ ID NO: 444 - DNA, 85 bp, Artificial Sequence
  Synthetic Oligonucleotide
ggaactggaatctctttccatagaatgttctaaaccatcctgcggcctctactctgcattcaattacatactgacacattcggca

SEQ ID NO: 445 - DNA, 85 bp, Artificial Sequence
  Synthetic Oligonucleotide
gtggaactggaatctctttccatagaatgttctaaaccatcctgcggcctctactctgcattcaattacatactgacacattcgg

SEQ ID NO: 446 - DNA, 85 bp, Artificial Sequence
  Synthetic Oligonucleotide
gcctggaactggaatctctttccatagaatgttctaaaccatcctgcggcctctactctgcattcaattacatactgacacattc

SEQ ID NO: 447 - DNA, 85 bp, Artificial Sequence
  Synthetic Oligonucleotide
gttcctggaactggaatctctttccatagaatgttctaaaccatcctgcggcctctactctgcattcaattacatactgacacat

SEQ ID NO: 448 - DNA, 85 bp, Artificial Sequence
  Synthetic Oligonucleotide
gggttcctggaactggaatctctttccatagaatgttctaaaccatcctgcggcctctactctgcattcaattacatactgacac

SEQ ID NO: 449 - DNA, 85 bp, Artificial Sequence
  Synthetic Oligonucleotide
gcaggttcctggaactggaatctctttccatagaatgttctaaaccatcctgcggcctctactctgcattcaattacatactgac

SEQ ID NO: 450 - DNA, 85 bp, Artificial Sequence
  Synthetic Oligonucleotide
gaccaggttcctggaactggaatctctttccatagaatgttctaaaccatcctgcggcctctactctgcattcaattacatactg

SEQ ID NO: 451 - DNA, 85 bp, Artificial Sequence
  Synthetic Oligonucleotide
ggtaccaggttcctggaactggaatctctttccatagaatgttctaaaccatcctgcggcctctactctgcattcaattacatac

SEQ ID NO: 452 - DNA, 85 bp, Artificial Sequence
  Synthetic Oligonucleotide
gatgtaccaggttcctggaactggaatctctttccatagaatgttctaaaccatcctgcggcctctactctgcattcaattacat

SEQ ID NO: 453 - DNA, 85 bp, Artificial Sequence
  Synthetic Oligonucleotide
ggtatgtaccaggttcctggaactggaatctctttccatagaatgttctaaaccatcctgcggcctctactctgcattcaattac

SEQ ID NO: 454 - DNA, 85 bp, Artificial Sequence
  Synthetic Oligonucleotide
gacgtatgtaccaggttcctggaactggaatctctttccatagaatgttctaaaccatcctgcggcctctactctgcattcaatt

SEQ ID NO: 455 - DNA, 85 bp, Artificial Sequence
  Synthetic Oligonucleotide
gacacgtatgtaccaggttcctggaactggaatctctttccatagaatgttctaaaccatcctgcggcctctactctgcattcaa

SEQ ID NO: 456 - DNA, 85 bp, Artificial Sequence
  Synthetic Oligonucleotide
gcaacacgtatgtaccaggttcctggaactggaatctctttccatagaatgttctaaaccatcctgcggcctctactctgcattc

SEQ ID NO: 457 - DNA, 85 bp, Artificial Sequence
  Synthetic Oligonucleotide
gcccaacacgtatgtaccaggttcctggaactggaatctctttccatagaatgttctaaaccatcctgcggcctctactctgcat

SEQ ID NO: 458 - DNA, 85 bp, Artificial Sequence
  Synthetic Oligonucleotide
ggacccaacacgtatgtaccaggttcctggaactggaatctctttccatagaatgttctaaaccatcctgcggcctctactctgc

SEQ ID NO: 459 - DNA, 85 bp, Artificial Sequence
  Synthetic Oligonucleotide
gttgacccaacacgtatgtaccaggttcctggaactggaatctctttccatagaatgttctaaaccatcctgcggcctctactct

SEQ ID NO: 460 - DNA, 85 bp, Artificial Sequence
  Synthetic Oligonucleotide
gccttgacccaacacgtatgtaccaggttcctggaactggaatctctttccatagaatgttctaaaccatcctgcggcctctact

SEQ ID NO: 461 - DNA, 85 bp, Artificial Sequence
  Synthetic Oligonucleotide
gggttccttgacccaacacgtatgtaccaggttcctggaactggaatctctttccatagaatgttctaaaccatcctgcggcctc

SEQ ID NO: 462 - DNA, 85 bp, Artificial Sequence
  Synthetic Oligonucleotide
gttggttccttgacccaacacgtatgtaccaggttcctggaactggaatctctttccatagaatgttctaaaccatcctgcggcc

SEQ ID NO: 463 - DNA, 85 bp, Artificial Sequence
  Synthetic Oligonucleotide
gccttggttccttgacccaacacgtatgtaccaggttcctggaactggaatctctttccatagaatgttctaaaccatcctgcgg

SEQ ID NO: 464 - DNA, 85 bp, Artificial Sequence
  Synthetic Oligonucleotide
ggcccttggttccttgacccaacacgtatgtaccaggttcctggaactggaatctctttccatagaatgttctaaaccatcctgc

SEQ ID NO: 465 - DNA, 85 bp, Artificial Sequence
  Synthetic Oligonucleotide
gccgcccttggttccttgacccaacacgtatgtaccaggttcctggaactggaatctctttccatagaatgttctaaaccatcct

SEQ ID NO: 466 - DNA, 85 bp, Artificial Sequence
  Synthetic Oligonucleotide
gcgccgcccttggttccttgacccaacacgtatgtaccaggttcctggaactggaatctctttccatagaatgttctaaaccatc

SEQ ID NO: 467 - DNA, 85 bp, Artificial Sequence
  Synthetic Oligonucleotide
ggtcgccgcccttggttccttgacccaacacgtatgtaccaggttcctggaactggaatctctttccatagaatgttctaaacca

SEQ ID NO: 468 - DNA, 30 bp, Artificial Sequence
  Synthetic Oligonucleotide
gtaatgcctggcttgtcgacgcatagtctg

SEQ ID NO: 469 - DNA, 51 bp, Artificial Sequence
  Synthetic Oligonucleotide
gaaaacgcaggttcctccagtttcgggagcagcgcacgtctccctgtagtc

SEQ ID NO: 470 - DNA, 51 bp, Artificial Sequence
  Synthetic Oligonucleotide
gacgcaggttcctctagcttcgggagcagcgcacgtctccctgtagtcaag

SEQ ID NO: 471 - DNA, 30 bp, Artificial Sequence; identical to SEQ ID NO: 468
  Synthetic Oligonucleotide

SEQ ID NO: 472 - DNA, 51 bp, Artificial Sequence; identical to SEQ ID NO: 375
  Synthetic Oligonucleotide

SEQ ID NO: 473 - DNA, 30 bp, Artificial Sequence; identical to SEQ ID NO: 468
  Synthetic Oligonucleotide

SEQ ID NO: 474 - DNA, 51 bp, Artificial Sequence
  Synthetic Oligonucleotide
gcaaggccacaaaattatccactgtttttggaacagtctttccgaagagac

SEQ ID NO: 475 - DNA, 51 bp, Artificial Sequence
  Synthetic Oligonucleotide
gcctgtagccaaggccacaaaattatccactgtttttggaacagtctttcc

SEQ ID NO: 476 - DNA, 51 bp, Artificial Sequence
  Synthetic Oligonucleotide
gctttctctcctgtagccaaggccacaaaattatccactgtttttggaaca

SEQ ID NO: 477 - DNA, 51 bp, Artificial Sequence
  Synthetic Oligonucleotide
ggccaaatcctttctctcctgtagccaaggccacaaaattatccactgttt

SEQ ID NO: 478 - DNA, 51 bp, Artificial Sequence
  Synthetic Oligonucleotide
gtttttgtagccaaatcctttctctcctgtagccaaggccacaaaattatc

SEQ ID NO: 479 - DNA, 51 bp, Artificial Sequence
  Synthetic Oligonucleotide
gatttgctgtttttgtagccaaatcctttctctcctgtagccaaggccaca

SEQ ID NO: 480 - DNA, 51 bp, Artificial Sequence
  Synthetic Oligonucleotide
gacgatggaatttgctgtttttgtagccaaatcctttctctcctgtagcca

SEQ ID NO: 481 - DNA, 51 bp, Artificial Sequence
  Synthetic Oligonucleotide
gatagaatgttctaaacgatcctgcggcctctactctgcattcaattacat

SEQ ID NO: 482 - DNA, 51 bp, Artificial Sequence
  Synthetic Oligonucleotide
gatagaatgttctaaacaatcctgcggcctctactctgcattcaattacat

SEQ ID NO: 483 - DNA, 51 bp, Artificial Sequence
  Synthetic Oligonucleotide
gatagaatgttctaaactatcctgcggcctctactctgcattcaattacat

SEQ ID NO: 484 - DNA, 51 bp, Artificial Sequence
  Synthetic Oligonucleotide
ggtcccacgcggcccacagctgcaccaggaagaagggtgcccagcacagca

SEQ ID NO: 485 - DNA, 51 bp, Artificial Sequence
  Synthetic Oligonucleotide
ggggtcccacgcggcccacagctgcaccaggaagaagggtgcccagcacag

SEQ ID NO: 486 - DNA, 51 bp, Artificial Sequence
  Synthetic Oligonucleotide
gccgggtcccacgcggcccacagctgcaccaggaagaagggtgcccagcac

SEQ ID NO: 487 - DNA, 51 bp, Artificial Sequence
  Synthetic Oligonucleotide
gggtgatgacatcccaggcgatcgtgtggcctccaggagcccagagcagga

SEQ ID NO: 488 - DNA, 51 bp, Artificial Sequence
  Synthetic Oligonucleotide
gagggtgatgacatcccaggcgatcgtgtggcctccaggagcccagagcag

SEQ ID NO: 489 - DNA, 51 bp, Artificial Sequence
  Synthetic Oligonucleotide
gatcagggtgatgacatcccaggcgatcgtgtggcctccaggagcccagag

SEQ ID NO: 490 - DNA, 51 bp, Artificial Sequence
  Synthetic Oligonucleotide
ggtggctccattcactccaatgctgagcacttccacagagtgggttaaagc

SEQ ID NO: 491 - DNA, 51 bp, Artificial Sequence
  Synthetic Oligonucleotide
gtttctaatatattttgccagactgatggactattctcaattaataatgat

SEQ ID NO: 492 - DNA, 51 bp, Artificial Sequence
  Synthetic Oligonucleotide
gagatgttgctgtggatccagtccacagccagcccgtcgggggcctggatg

SEQ ID NO: 493 - DNA, 51 bp, Artificial Sequence
  Synthetic Oligonucleotide
gcaggccggcccagctgccaggtgcacctgctcggagcatcgggccggatc

SEQ ID NO: 494 - DNA, 51 bp, Artificial Sequence
  Synthetic Oligonucleotide
gcaaagaacctctgggtccaagggtagaccaccagcagcctgcccagggcc

SEQ ID NO: 495 - DNA, 51 bp, Artificial Sequence
  Synthetic Oligonucleotide
gaagagaaacttagtttccagggctttggtagagggcaaaggttgatagca

SEQ ID NO: 496 - DNA, 51 bp, Artificial Sequence
  Synthetic Oligonucleotide
gtcagcctagtgcagagccactggtagttggtggttagagtttcaagttcc

SEQ ID NO: 497 - DNA, 51 bp, Artificial Sequence
  Synthetic Oligonucleotide
ggctcattgtgaacaggccagtaatgtccgggatggggcggcataggcggg

SEQ ID NO: 498 - DNA, 51 bp, Artificial Sequence
  Synthetic Oligonucleotide
gtagctaaagaacttgaccaagacatatcaggatccacctcagctcctaga

SEQ ID NO: 499 - DNA, 51 bp, Artificial Sequence
  Synthetic Oligonucleotide
ggggcattgttctgtgcccagtcctgctggtagacctgctccccggtggct

SEQ ID NO: 500 - DNA, 51 bp, Artificial Sequence
  Synthetic Oligonucleotide
gagaagtcgttcatgtgccaccgtgggagcgtacagtcatcattgatcttg

SEQ ID NO: 501 - skipped

SEQ ID NO: 502 - DNA, 51 bp, Artificial Sequence
  Synthetic Oligonucleotide
gatgaatgaacgatttcccagaactccctaatcagaacagagtccctggta

SEQ ID NO: 503 - DNA, 51 bp, Artificial Sequence
  Synthetic Oligonucleotide
ggagcctctgccggagcccagagaacccgagagtcagacagagccagcgcc

SEQ ID NO: 504 - DNA, 51 bp, Artificial Sequence
  Synthetic Oligonucleotide
ggcttccgtggagacacccaatcaatttgaagagatcttgaagtgatgcca

SEQ ID NO: 505 - DNA, 51 bp, Artificial Sequence
  Synthetic Oligonucleotide
gtgggactgccctcctcccatttgcagatgccgtcgtagaatcgcagcagg

SEQ ID NO: 506 - DNA, 51 bp, Artificial Sequence
  Synthetic Oligonucleotide
gcttcttcaatagttctccagctacactggcaggcatatgcccgtgttcct

SEQ ID NO: 507 - DNA, 51 bp, Artificial Sequence
  Synthetic Oligonucleotide
gattccttttcttcgtcccaattcacctcagtggctagtcgaagaatgaag

SEQ ID NO: 508 - DNA, 51 bp, Artificial Sequence
  Synthetic Oligonucleotide
gcagcttcagcaccttccagtcagactcctgcttcaagcactgcagcagga

SEQ ID NO: 509 - DNA, 51 bp, Artificial Sequence
  Synthetic Oligonucleotide
gccatttgcttgcagtgccactccagaggattccggattgccataaatact

SEQ ID NO: 510 - DNA, 51 bp, Artificial Sequence
  Synthetic Oligonucleotide
gttcaatagttttggtccagtatcgtttacagcccttcttggtagatttca

SEQ ID NO: 511 - DNA, 51 bp, Artificial Sequence
  Synthetic Oligonucleotide
ggcaaccgtcttctgaccaaatggcagaacatttgtccccaactttccact

SEQ ID NO: 512 - DNA, 51 bp, Artificial Sequence
  Synthetic Oligonucleotide
gcgactttccaatgaaccactgaagcccaggtatgacaaagccgatgatct

SEQ ID NO: 513 - DNA, 51 bp, Artificial Sequence
  Synthetic Oligonucleotide
gtttacactcatgcttccacagctttaacagatcatttggttccttgatga

SEQ ID NO: 514 - DNA, 51 bp, Artificial Sequence
  Synthetic Oligonucleotide
gcttaagcttccgtgtccagccttcaggcagggtggggtcatcatacatgg

SEQ ID NO: 515 - DNA, 51 bp, Artificial Sequence
  Synthetic Oligonucleotide
ggacagctgggctgatccatgatgtcatccagaaacactggggaccctcag

SEQ ID NO: 516 - DNA, 51 bp, Artificial Sequence
  Synthetic Oligonucleotide
gtctcatctcaactttccatatccgtatcatggaatcatagcatcctgtaa

SEQ ID NO: 517 - DNA, 51 bp, Artificial Sequence
  Synthetic Oligonucleotide
gcatgcagacgcggttccactcgcagccacagttccagcaccactcgagcc

SEQ ID NO: 518 - DNA, 51 bp, Artificial Sequence
  Synthetic Oligonucleotide
gttggttagggtcaacccagtattctccactcttgagttcaggatggcaga

SEQ ID NO: 519 - DNA, 51 bp, Artificial Sequence
  Synthetic Oligonucleotide
gctacactgtccaacacccactctcgggtcaccacaggtgcctcacacatc

SEQ ID NO: 520 - DNA, 51 bp, Artificial Sequence
  Synthetic Oligonucleotide
gctgcactgtgtacccccagagctccgtgttgccgacatcctggggtggct

SEQ ID NO: 521 - DNA, 51 bp, Artificial Sequence
  Synthetic Oligonucleotide
gagcttcctgccactcccaacaggtttcacagtaagcgcgtatctgttcca

SEQ ID NO: 522 - DNA, 51 bp, Artificial Sequence
  Synthetic Oligonucleotide
gacggcaagagcttacccagtcacttgtgtggagacttaaatacttgcata

SEQ ID NO: 523 - DNA, 51 bp, Artificial Sequence; identical to SEQ ID NO: 474
  Synthetic Oligonucleotide

SEQ ID NO: 524 - DNA, 51 bp, Artificial Sequence; identical to SEQ ID NO: 475
  Synthetic Oligonucleotide

SEQ ID NO: 525 - DNA, 51 bp, Artificial Sequence; identical to SEQ ID NO: 476
  Synthetic Oligonucleotide

SEQ ID NO: 526 - DNA, 51 bp, Artificial Sequence; identical to SEQ ID NO: 477
  Synthetic Oligonucleotide

SEQ ID NO: 527 - DNA, 51 bp, Artificial Sequence; identical to SEQ ID NO: 478
  Synthetic Oligonucleotide

SEQ ID NO: 528 - DNA, 51 bp, Artificial Sequence; identical to SEQ ID NO: 479
  Synthetic Oligonucleotide

SEQ ID NO: 529 - DNA, 51 bp, Artificial Sequence; identical to SEQ ID NO: 480
  Synthetic Oligonucleotide

SEQ ID NO: 530 - DNA, 30 bp, Artificial Sequence; identical to SEQ ID NO: 468
  Synthetic Oligonucleotide

SEQ ID NO: 531 - DNA, 51 bp, Artificial Sequence; identical to SEQ ID NO: 375
  Synthetic Oligonucleotide

SEQ ID NO: 532 - DNA, 34 bp, Artificial Sequence
  Synthetic Oligonucleotide
gcagggttttcccagtcacgacgttgtaaagttg

SEQ ID NO: 533 - DNA, 51 bp, Artificial Sequence
  Synthetic Oligonucleotide
gtcaaggcactcttgcccacgccaccagctccaactaccacaagtttatat

SEQ ID NO: 534 - DNA, 51 bp, Artificial Sequence
  Synthetic Oligonucleotide
gcaaagatcacccggcccacatcttcatctccaattcgtaggtcaaaatac

SEQ ID NO: 535 - DNA, 51 bp, Artificial Sequence
  Synthetic Oligonucleotide
gcgccaccagctccaaccaccacaagtttatattcagtcattttcagcagg

SEQ ID NO: 536 - DNA, 51 bp, Artificial Sequence
  Synthetic Oligonucleotide
gtttctccatcaattaccacttgcttcctgtaggaatcctctattgttgga

SEQ ID NO: 537 - DNA, 51 bp, Artificial Sequence; identical to SEQ ID NO: 476
  Synthetic Oligonucleotide

SEQ ID NO: 538 - DNA, 30 bp, Artificial Sequence; identical to SEQ ID NO: 468
  Synthetic Oligonucleotide

SEQ ID NO: 539 - DNA, 83 bp, Artificial Sequence
  Synthetic Oligonucleotide
tctttccataggccctgaaaaagggcctgttctaaaccatcctgcggcctctactcggccctgaaaaagggccattcaattac

SEQ ID NO: 540 - DNA, 83 bp, Artificial Sequence
  Synthetic Oligonucleotide
cagctggcgaggccctgaaaaagggccggggatgtgccgcaaggcgattaagttggggccctgaaaaagggccacgccagggt

SEQ ID NO: 541 - DNA, 79 bp, Artificial Sequence
  Synthetic Oligonucleotide
gtggaatagtataacaatatgctaaatgttgttatagtatcccactctaaaccatcctgcggggccctcttcagggccc

SEQ ID NO: 542 - DNA, 79 bp, Artificial Sequence
  Synthetic Oligonucleotide
gtggaatagtataacaatatgctaaatgttgttatagtatcccacaccctggcgttacccagggccctcttcagggccc

SEQ ID NO: 543 - RNA, 27 nt, Artificial Sequence
  Synthetic Oligonucleotide
  misc_feature (1)..(4): n is a, c, g, or u
  misc_feature (13)..(16): n is a, c, g, or u
nnnngacuacagnnnnucccgaaaugg

SEQ ID NO: 544 - RNA, 28 nt, Artificial Sequence
  Synthetic Oligonucleotide
  misc_feature (1)..(4): n is a, c, g, or u
  misc_feature (13)..(16): n is a, c, g, or u
nnnngacuacagnnnnucccgaaacuag

SEQ ID NO: 545 - DNA, 85 bp, Artificial Sequence
  Synthetic Oligonucleotide
gttccttgacccaacacgtatgtaccaggttcctggaactggaatctctttccatagaatgttctaaaccatcctgcggcctcta

SEQ ID NO: 546 - DNA, 51 bp, Artificial Sequence
  Synthetic Oligonucleotide
gggattaatgctgaacgcaccaaagttcatcccaccacccatattactacc

SEQ ID NO: 547 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 548 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 549 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 550 - protein, 1090 aa, Prevotella sp.; identical to SEQ ID NO: 160

SEQ ID NO: 551 - protein, 1090 aa, Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 552 - protein, 1199 aa, Capnocytophaga canimorsus; identical to SEQ ID NO: 158

SEQ ID NO: 553 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 554 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 555 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 556 - protein, 1135 aa, Porphyromonas gingivalis; identical to SEQ ID NO: 149

SEQ ID NO: 557 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 558 - protein, 1135 aa, Porphyromonas gingivalis; identical to SEQ ID NO: 557

SEQ ID NO: 559 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 560 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 561 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 562 - protein, 1135 aa, Porphyromonas gingivalis; identical to SEQ ID NO: 561

SEQ ID NO: 563 - protein, 1135 aa, Porphyromonas gingivalis; identical to SEQ ID NO: 560

SEQ ID NO: 564 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 565 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 566 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 567 - protein, 1115 aa, Bacteroides pyogenes; identical to SEQ ID NO: 150

SEQ ID NO: 568 - protein, 953 aa, Alistipes sp.; identical to SEQ ID NO: 151

SEQ ID NO: 569 - protein, 1150 aa, Flavobacterium branchiophilum; identical to SEQ ID NO: 161

SEQ ID NO: 570 - protein, 1322 aa, Prevotella sp.; identical to SEQ ID NO: 152

SEQ ID NO: 571 - protein, 1159 aa, Myroides odoratimimus; identical to SEQ ID NO: 156

SEQ ID NO: 572 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 573 - protein, 1157 aa, Myroides odoratimimus; identical to SEQ ID NO: 572

SEQ ID NO: 574 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 575 - protein, 1157 aa, Myroides odoratimimus; identical to SEQ ID NO: 574

SEQ ID NO: 576 - protein, 1159 aa, Myroides odoratimimus; identical to SEQ ID NO: 162

SEQ ID NO: 577 - protein, 1224 aa, Bergeyella zoohelcum; identical to SEQ ID NO: 146

SEQ ID NO: 578 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 579 - protein, 1224 aa, Bergeyella zoohelcum; identical to SEQ ID NO: 146

SEQ ID NO: 580 - protein, 1155 aa, Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 581 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 582 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 583 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 584 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 585 - protein, 1214 aa, Flavobacterium columnare; identical to SEQ ID NO: 163

SEQ ID NO: 586 - protein, 1145 aa, Chryseobacterium sp.
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 587 - protein, 1095 aa, Riemerella anatipestifer; identical to SEQ ID NO: 153

SEQ ID NO: 588 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 589 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 590 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 591 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 592 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 593 - protein, 1151 aa, Prevotella saccharolytica; identical to SEQ ID NO: 155

SEQ ID NO: 594 - protein, 1127 aa, Prevotella buccae; identical to SEQ ID NO: 148

SEQ ID NO: 595 - protein, 1127 aa, Prevotella buccae; identical to SEQ ID NO: 148

SEQ ID NO: 596 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 597 - protein, 1127 aa, Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 598 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 599 - protein, 1125 aa, Prevotella pallens; identical to SEQ ID NO: 598

SEQ ID NO: 600 - protein, 1126 aa, Prevotella intermedia; identical to SEQ ID NO: 147

SEQ ID NO: 601 - protein, 1120 aa, Prevotella intermedia; identical to SEQ ID NO: 157

SEQ ID NO: 602 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 603 - protein, 1132 aa, Prevotella intermedia; identical to SEQ ID NO: 166

SEQ ID NO: 604 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 605 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 606 - protein, 1124 aa, Prevotella aurantiaca; identical to SEQ ID NO: 154

SEQ ID NO: 607 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 608 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 609 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 610 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 611 - protein, 1175 aa, Porphyromonas sp.; identical to SEQ ID NO: 165

SEQ ID NO: 612 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 613 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 614 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 615 - protein, 1175 aa, Porphyromonas gulae; identical to SEQ ID NO: 159

SEQ ID NO: 616 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 617 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 618 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 619 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 620 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 621 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 622 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 623 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 624 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 625 - protein, 1119 aa, Porphyromonas gingivalis; identical to SEQ ID NO: 164

SEQ ID NO: 626 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 627 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 628 - protein, 1161 aa, Bacteroidetes bacterium GWA2_31_9
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 629 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 630 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 631 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 632 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 633 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 634 - protein, 6 aa, Artificial Sequence
  Synthetic effector protein
GCCACC

SEQ ID NO: 635 - protein, 4 aa, Artificial Sequence
  Synthetic
FWYH

SEQ ID NO: 636 - protein, 5 aa, Artificial Sequence
  Synthetic
HKRED

What is claimed is:

1. A non-naturally occurring or engineered composition comprising;
   i) a Type VI-B Cas protein optimized for activity in a mammalian cell, and
   ii) one or more nucleic acid components, the one or more nucleic acid components capable of forming a complex with the Type VI-B Cas protein and comprising a guide sequence capable of directing site specific binding of the complex to a target RNA polynucleotide sequence wherein the Type VI-B Cas protein is selected from the group consisting of *Porphyromonas gulae* Cas13b as set forth in SEQ ID NO: 159, *Prevotella* sp. P5-125 Cas13b as set forth in SEQ ID NO: 160, *Porphyromonas gingivalis* Cas13b as set forth in SEQ ID NO: 164, *Porphyromonas* sp. COT-052 OH4946 Cas13b as set forth in SEQ ID NO: 165, *Bacteroides pyogenes* Cas13b as set forth in SEQ ID NO: 150, and *Riemerella anatipestifer* Cas13b as set forth in SEQ ID NO: 153.

2. The composition of claim 1, wherein the Type VI-B Cas protein is fused to one or more localization signals.

3. The composition of claim 1, wherein the localization signal is a nuclear localization signal (NLS) or a nuclear export signal (NES).

4. The composition of claim 1, wherein the Type VI-B Cas protein comprises two HEPN domains.

5. The composition of claim 1, wherein the Type VI-B Cas protein is associated with one or more functional domains.

6. The composition of claim 5, wherein the functional domain modifies transcription or translation of the target sequence.

7. The composition of claim 6, wherein the functional domain comprises a cytosine or adenosine deaminase.

8. The composition of claim 1, wherein the nucleic acid component comprises a dual direct repeat sequence.

9. The composition of claim 1, wherein the Type VI-B Cas protein is *Porphyromonas gulae* Cas13b as set forth in SEQ ID NO: 159, or *Prevotella* sp. P5-125 Cas13b as set forth in SEQ ID NO: 160.

10. The composition of claim 1, wherein the Type VI-B Cas protein contains one or more mutations within a HEPN domain corresponding to amino acid positions R116, H121, R1177, or H1182 of Type VI-B *Bergeyella zoohelcum* ATCC 43767 as set forth in SEQ ID NO: 146.

11. The composition of claim 1, wherein the one or more polynucleotide molecules comprise one or more regulatory elements operably configured to express the polypeptides and/or the nucleic acid component(s), optionally wherein the one or more regulatory elements comprise a promoter(s) or inducible promotor(s).

12. The composition of claim 11, wherein the one or more polynucleotide molecules are comprised within one or more vectors.

13. The composition of claim 11, wherein the composition is comprised in a delivery system.

14. A method of targeting a locus of interest in a eukaryotic cell, the method comprising delivering to said locus a non-naturally occurring or engineered composition comprising
   i) a Type VI-B Cas protein optimized for activity in a mammalian cell; and
   ii) one or more nucleic acid components, the one or more nucleic acid components capable of forming a complex with the Type VI-B Cas protein and comprising a guide sequence capable of directing site specific binding of the complex to a target RNA polynucleotide sequence wherein the Type VI-B Cas protein is selected from the group consisting of *Porphyromonas gulae* Cas13b as set forth in SEQ ID NO: 159, *Prevotella* sp. P5-125 Cas13b as set forth in SEQ ID NO: 160, *Porphyromonas gingivalis* Cas13b as set forth in SEQ ID NO: 164, *Porphyromonas* sp. COT-052 OH4946 Cas13b as set forth in SEQ ID NO: 165, *Bacteroides pyogenes* Cas13b as set forth in SEQ ID NO: 150, and *Riemerella anatipestifer* Cas13b as set forth in SEQ ID NO: 153.

15. The method of claim 14, wherein the targeting is in vivo or ex vivo.

16. The method of claim 14, wherein the Type VI-B Cas protein is fused to one or more localization signals.

17. The method of claim 16, wherein the localization signal is a nuclear localization signal (NLS) or a nuclear export signal (NES).

18. The method of claim 14, wherein the Type VI-B Cas protein contains one or more mutations within a HEPN domain corresponding to amino acid positions R116, H121, R1177, or H1182 of Type VI-B *Bergeyella zoohelcum* ATCC 43767 as set forth in SEQ ID NO: 146.

19. The method of claim 14, wherein the Type VI-B Cas protein is associated with one or more functional domains.

20. The method of claim 19, wherein the functional domain is a cytosine or adenosine deaminase functional domain associated with the Type VI-B Cas protein, and the target RNA sequence comprises one or more Adenine or Cytidine.

* * * * *

UNITED STATES PATENT AND TRADEMARK OFFICE
CERTIFICATE OF CORRECTION

| | |
|---|---|
| PATENT NO. | : 11,840,711 B2 |
| APPLICATION NO. | : 16/604724 |
| DATED | : December 12, 2023 |
| INVENTOR(S) | : Zhang et al. |

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 763 days.

Signed and Sealed this
First Day of July, 2025

Coke Morgan Stewart
*Acting Director of the United States Patent and Trademark Office*